(12) United States Patent
Challita-Eid et al.

(10) Patent No.: US 7,135,549 B1
(45) Date of Patent: Nov. 14, 2006

(54) NUCLEIC ACID AND CORRESPONDING PROTEIN ENTITLED 184P1E2 USEFUL IN TREATMENT AND DETECTION OF CANCER

(75) Inventors: Pia M. Challita-Eid, Encino, CA (US); Arthur B. Raitano, Los Angeles, CA (US); Mary Faris, Los Angeles, CA (US); Rene S. Hubert, Los Angeles, CA (US); Karen Jane Meyrick Morrison, Santa Monica, CA (US); Robert Kendall Morrison, Santa Monica, CA (US); Wangmao Ge, Culver City, CA (US); Aya Jakobovits, Beverly Hills, CA (US)

(73) Assignee: Agensys, Inc., Santa Monica, CA (US)

( * ) Notice: Subject to any disclaimer, the term of this patent is extended or adjusted under 35 U.S.C. 154(b) by 186 days.

(21) Appl. No.: 10/120,901

(22) Filed: Apr. 9, 2002

Related U.S. Application Data

(60) Provisional application No. 60/286,630, filed on Apr. 25, 2001, provisional application No. 60/282,739, filed on Apr. 10, 2001.

(51) Int. Cl.
  *A61K 38/00* (2006.01)
  *C07K 2/00* (2006.01)
  *C07K 4/00* (2006.01)
  *C07K 5/00* (2006.01)
  *C07K 7/00* (2006.01)

(52) U.S. Cl. ............ 530/350; 530/300; 514/2; 435/183; 435/229; 435/4; 435/6; 435/7.1; 435/7.21; 435/7.23; 436/63; 436/64; 436/86; 436/174; 424/184.1; 424/185.1

(58) Field of Classification Search ........ 530/300, 530/350; 514/2; 435/183, 229, 4, 6, 7.1, 435/7.21, 7.23; 436/63, 64, 86, 174; 424/184.1, 424/185.1
See application file for complete search history.

(56) References Cited

FOREIGN PATENT DOCUMENTS

| | | |
|---|---|---|
| WO | WO200055351 | 9/2000 |
| WO | WO200058473 | 10/2000 |
| WO | WO200153339 | 7/2001 |
| WO | WO200155320 | 8/2001 |
| WO | WO200155325 | 8/2001 |
| WO | WO200157182 | 8/2001 |
| WO | WO200157271 | 8/2001 |
| WO | WO200157273 | 8/2001 |
| WO | WO200157274 | 8/2001 |
| WO | WO200157275 | 8/2001 |
| WO | WO200157276 | 8/2001 |
| WO | WO200175067 | 10/2001 |
| WO | WO200188188 | 11/2001 |
| WO | WO200210449 | 2/2002 |
| WO | WO200283919 | 10/2002 |
| WO | WO200290531 | 11/2002 |
| WO | WO2003010327 | 2/2003 |

OTHER PUBLICATIONS

Reiger et al. (Glossary of Genetics and Cytogenetics, Classical and Molecular, 4th Ed., Springer-Verlay, Berlin, 1976.*
Burgess et al, Journal of Cell Biology vol. 111 Nov. 1990 2129-2138.*
Lazar et al Molecular and Cellular Biology Mar. 1988 vol. 8 No. 3 1247-1252.*
Schwartz et al, Proc Natl Acad Sci USA vol. 84:6408-6411 (1987.*
Lin et al Biochemistry USA vol. 14:1559-1563 (1975.*
Kanno et al (J. Invest. Dermatol. 115:813-23, Nov. 2000.*
Rus'd et al (Eur. J. Biochem 259:660-669, 1999.*
GenBank Accession No. Q9ULW8, Kanno et al. (2000).
International Preliminary Examination Report for PCT/US02/11643, mailed on Feb. 15, 2005, 6 pages.

* cited by examiner

*Primary Examiner*—Alana M. Harris
(74) *Attorney, Agent, or Firm*—Morrison & Foerster LLP

(57) ABSTRACT

A novel gene (designated 184P1E2) and its encoded protein, and variants thereof, are described wherein 184P1E2 exhibits tissue specific expression in normal adult tissue, and is aberrantly expressed in the cancers listed in Table I. Consequently, 184P1E2 provides a diagnostic, prognostic, prophylactic and/or therapeutic target for cancer. The 184P1E2 gene or fragment thereof, or its encoded protein, or variants thereof, or a fragment thereof, can be used to elicit a humoral or cellular immune response; antibodies or T cells reactive with 184P1E2 can be used in active or passive immunization.

15 Claims, 55 Drawing Sheets

FIGURE 1. 184P1E2 SSH SEQUENCE OF 132 NUCLEOTIDES.

```
  1 gatccacagc tcccttttta tgggggaggc tttaggaaga atctctcctg cctgtcctgc
 61 gtggagtggt ctggttttag ggttgttcct ctgcagagag gaagcaattg gaccaaagca
121 gaatcatgga tc
```

Figure 2A. The cDNA (SEQ ID. NO. : 2) and amino acid sequence (SEQ ID. NO. : 3) of 184P1E2 v.1. The start methionine is underlined. The open reading frame extends from nucleic acid 42-2036 including the stop codon.

```
   1                                               M   S   L   Q   R   I   V
   1 gagtgttggggttggcggccacagctaagtccaacaccagcATGTCGCTGCAGAGAATCG
   8     R   V   S   L   E   H   P   T   S   A   V   C   V   A   G   V   E   T   L   V
  61 TGCGTGTGTCCCTGGAGCATCCCACCAGCGCGGTGTGTGTGGCTGGCGTGGAGACCCTCG
  28     D   I   Y   G   S   V   P   E   G   T   E   M   F   E   V   Y   G   T   P   G
 121 TGGACATTTATGGGTCAGTGCCTGAGGGCACAGAAATGTTTGAGGTCTATGGGACGCCTG
  48     V   D   I   Y   I   S   P   N   M   E   R   G   R   E   R   A   D   T   R   R
 181 GCGTGGACATCTACATCTCTCCCAACATGGAGAGGGGCCGGGAGCGTGCAGACACCAGGC
  68     W   R   F   D   A   T   L   E   I   I   V   V   M   N   S   P   S   N   D   L
 241 GGTGGCGCTTTGACGCGACTTTGGAGATCATCGTGGTCATGAACTCCCCCAGCAATGACC
  88     N   D   S   H   V   Q   I   S   Y   H   S   S   H   E   P   L   P   L   A   Y
 301 TCAACGACAGCCATGTTCAGATTTCCTACCACTCCAGCCATGAGCCTCTGCCCCTGGCCT
 108     A   V   L   Y   L   T   C   V   D   I   S   L   D   C   D   L   N   C   E   G
 361 ATGCGGTGCTCTACCTCACCTGTGTTGACATCTCTCTGGATTGCGACCTGAACTGTGAGG
 128     R   Q   D   R   N   F   V   D   K   R   Q   W   V   W   G   P   S   G   Y   G
 421 GAAGGCAGGACAGGAACTTTGTAGACAAGCGGCAGTGGGTCTGGGGGCCCAGTGGGTATG
 148     G   I   L   L   V   N   C   D   R   D   D   P   S   C   D   V   Q   D   N   C
 481 GCGGCATCTTGCTGGTGAACTGTGACCGTGATGATCCGAGCTGTGATGTCCAGGACAATT
 168     D   Q   H   V   H   C   L   Q   D   L   E   D   M   S   V   M   V   L   R   T
 541 GTGACCAGCACGTGCACTGCCTGCAAGACCTGGAAGACATGTCTGTCATGGTCCTGCGGA
 188     Q   G   P   A   A   L   F   D   D   H   K   L   V   L   H   T   S   S   Y   D
 601 CGCAGGGCCCTGCAGCCCTCTTTGATGACCACAAACTTGTCCTCCATACCTCCAGCTATG
 208     A   K   R   A   Q   V   F   H   I   C   G   P   E   D   V   C   E   A   Y   R
 661 ATGCCAAACGGGCACAGGTCTTCCACATCTGCGGTCCTGAGGATGTGTGTGAGGCCTATA
 228     H   V   L   G   Q   D   K   V   S   Y   E   V   P   R   L   H   G   D   E   E
 721 GGCATGTGCTGGGCCAAGATAAGGTGTCCTATGAGGTACCCCGCTTGCATGGGGATGAGG
 248     R   F   F   V   E   G   L   S   F   P   D   A   G   F   T   G   L   I   S   F
 781 AGCGCTTCTTCGTGGAAGGCCTGTCCTTCCCTGATGCCGGCTTCACAGGACTCATCTCCT
 268     H   V   T   L   L   D   D   S   N   E   D   F   S   A   S   P   I   F   T   D
 841 TCCATGTCACTCTGCTGGACGACTCCAACGAGGATTTCTCGGCATCCCCTATCTTCACTG
 288     T   V   V   F   R   V   A   P   W   I   M   T   P   S   T   L   P   P   L   E
 901 ACACTGTGGTGTTCCGAGTGGCACCCTGGATCATGACGCCCAGCACTCTGCCACCCCTAG
 308     V   Y   V   C   R   V   R   N   N   T   C   F   V   D   A   V   A   E   L   A
 961 AGGTGTATGTGTGCCGTGTGAGGAACAACACGTGTTTTGTGGATGCGGTGGCAGAGCTGG
 328     R   K   A   G   C   K   L   T   I   C   P   Q   A   E   N   R   N   D   R   W
1021 CCAGGAAGGCCGGCTGCAAGCTGACCATCTGCCCACAGGCCGAGAACCGCAACGACCGCT
```

Figure 2A-1

```
348  I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368  F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388  D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408  G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428  I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448  D  F  L  H  A  Q  K  V  Q  P  P  V  E  L  F  V  D  W  L  A
1381 GGGACTTCCTCCATGCCCAGAAGGTGCAGCCCCCGTGGAGCTCTTTGTGGACTGGTTGG
468  V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488  M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508  H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528  I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548  I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568  D  I  P  Q  L  F  K  T  E  R  K  K  A  F  F  P  D  L
1741 TTGACATCCCACAGCTCTTCAAGACCGAGAGGAAAAAAGCAACGGCCTTCTTCCCTGACT
588  V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608  N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628  C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648  T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2A-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtgggggcccggttctcgaggtgtgtgccagcta
3121 cacgtgtgttctgtatgggtccagctgcgtttccatcactcgctaataaatcaacagaaa
3181 cac
```

Figure 2A-3

Figure 2B. The cDNA (SEQ ID. NO. :4) and amino acid sequence (SEQ ID. NO. : 5) of 184P1E2 v.2. The start methionine is underlined. The open reading frame extends from nucleic acid 42-2036 including the stop codon.

```
                                                 M   S   L   Q   R   I   V
  1 gagtgttggggttggcggccacagctaagtccaacaccagcATGTCGCTGCAGAGAATCG
    8    R   V   S   L   E   H   P   T   S   A   V   C   A   G   V   E   T   L   V
 61 TGCGTGTGTCCCTGGAGCATCCCACCAGCGCGGTGTGTGTGGCTGGCGTGGAGACCCTCG
   28    D   I   Y   G   S   V   P   E   G   T   E   M   F   E   V   Y   G   T   P   G
121 TGGACATTTATGGGTCAGTGCCTGAGGGCACAGAAATGTTTGAGGTCTATGGGACGCCTG
   48    V   D   I   Y   I   S   P   N   M   E   R   G   E   R   A   D   T   R   R
181 GCGTGGACATCTACATCTCTCCCAACATGGAGAGGGGCCGGGAGCGTGCAGACACCAGGC
   68    W   R   F   D   A   T   L   E   I   I   V   V   M   N   S   P   S   N   D   L
241 GGTGGCGCTTTGACGCGACTTTGGAGATCATCGTGGTCATGAACTCCCCCAGCAATGACC
   88    N   D   S   H   V   Q   I   S   Y   H   S   S   H   E   P   L   P   L   A   Y
301 TCAACGACAGCCATGTTCAGATTTCCTACCACTCCAGCCATGAGCCTCTGCCCCTGGCCT
  108    A   V   L   Y   L   T   C   V   D   I   S   L   D   C   D   L   N   C   E   G
361 ATGCGGTGCTCTACCTCACCTGTGTTGACATCTCTCTGGATTGCGACCTGAACTGTGAGG
  128    R   Q   D   R   N   F   V   D   K   R   Q   W   V   W   G   P   S   G   Y   G
421 GAAGGCAGGACAGGAACTTTGTAGACAAGCGGCAGTGGGTCTGGGGGCCCAGTGGGTATG
  148    G   I   L   L   V   N   C   D   R   D   D   P   S   C   D   V   Q   D   N   C
481 GCGGCATCTTGCTGGTGAACTGTGACCGTGATGATCCGAGCTGTGATGTCCAGGACAATT
  168    D   Q   H   V   H   C   L   Q   D   L   E   D   M   S   V   M   V   L   R   T
541 GTGACCAGCACGTGCACTGCCTGCAAGACCTGGAAGACATGTCTGTCATGGTCCTGCGGA
  188    Q   G   P   A   A   L   F   D   D   H   K   L   V   L   H   T   S   S   Y   D
601 CGCAGGGCCCTGCAGCCCTCTTTGATGACCACAAACTTGTCCTCCATACCTCCAGCTATG
  208    A   K   R   A   Q   V   F   H   I   C   G   P   E   D   V   C   E   A   Y   R
661 ATGCCAAACGGGCACAGGTCTTCCACATCTGCGGTCCTGAGGATGTGTGTGAGGCCTATA
  228    H   V   L   G   Q   D   K   V   S   Y   E   V   P   R   L   H   G   D   E   E
721 GGCATGTGCTGGGCCAAGATAAGGTGTCCTATGAGGTACCCCGCTTGCATGGGGATGAGG
  248    R   F   F   V   E   G   L   S   F   P   D   A   G   F   T   G   L   I   S   F
781 AGCGCTTCTTCGTGGAAGGCCTGTCCTTCCCTGATGCCGGCTTCACAGGACTCATCTCCT
  268    H   V   T   L   L   D   D   S   N   E   D   F   S   A   S   P   I   F   T   D
841 TCCATGTCACTCTGCTGGACGACTCCAACGAGGATTTCTCGGCATCCCCTATCTTCACTG
  288    T   V   V   F   R   V   A   P   W   I   M   T   P   S   T   L   A   P   L   E
901 ACACTGTGGTGTTCCGAGTGGCACCCTGGATCATGACGCCCAGCACTCTGGCACCCCTAG
  308    V   Y   V   C   R   V   R   N   N   T   C   F   V   D   A   V   A   E   L   A
961 AGGTGTATGTGTGCCGTGTGAGGAACAACACGTGTTTTGTGGATGCGGTGGCAGAGCTGG
  328    R   K   A   G   C   K   L   T   I   C   P   Q   A   E   N   R   N   D   R   W
```

```
1021 CCAGGAAGGCCGGCTGCAAGCTGACCATCTGCCCACAGGCCGAGAACCGCAACGACCGCT
 348    I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
 368    F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
 388    D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
 408    G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
 428    I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
 448    D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
 468    V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
 488    M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
 508    H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
 528    I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
 548    I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
 568    D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
 588    V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
 608    N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
 628    C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
 648    T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
```

Figure 2B-2

```
2461 acaaccccaaaaccagaccactccacgcaggacaggcaggagagattcttcctaaagcct
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctgggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagagggggctaaggggctggatccaccaaggcagctcacagcgggaaaactctgggac
3061 tgaaccactgaattcaggggatgggggtggggcccggttctcgaggtgtgtgccagcta
3121 cacgtgtgttctgtatgggtccagctgcgtttccatcactcgctaataaatcaacagaaa
3181 cac
```

Figure 2B-3

Figure 2C. The cDNA (SEQ ID. NO.: 6) and amino acid sequence (SEQ ID. NO.: 7) of 184P1E2 v.3. The start methionine is underlined. The open reading frame extends from nucleic acid 42-2036 including the stop codon.

```
1                                                    M   S   L   Q   R   I   V
    1 gagtgttggggttggcggccacagctaagtccaacaccagcATGTCGCTGCAGAGAATCG
    8   R   V   S   L   E   H   P   T   S   A   V   C   V   A   G   V   E   T   L   V
   61 TGCGTGTGTCCCTGGAGCATCCCACCAGCGCGGTGTGTGTGGCTGGCGTGGAGACCCTCG
   28   D   I   Y   G   S   V   P   E   G   T   E   M   F   E   V   Y   G   T   P   G
  121 TGGACATTTATGGGTCAGTGCCTGAGGGCACAGAAATGTTTGAGGTCTATGGGACGCCTG
   48   V   D   I   Y   I   S   P   N   M   E   R   G   R   E   A   D   T   R   R
  181 GCGTGGACATCTACATCTCTCCCAACATGGAGAGGGGCCGGGAGCGTGCAGACACCAGGC
   68   W   R   F   D   A   T   L   E   I   I   V   V   M   N   S   P   S   N   D   L
  241 GGTGGCGCTTTGACGCGACTTTGGAGATCATCGTGGTCATGAACTCCCCCAGCAATGACC
   88   N   D   S   H   V   Q   I   S   Y   H   S   S   H   E   P   L   P   L   A   Y
  301 TCAACGACAGCCATGTTCAGATTTCCTACCACTCCAGCCATGAGCCTCTGCCCCTGGCCT
  108   A   V   L   Y   L   T   C   V   D   I   S   L   D   C   D   L   N   C   E   G
  361 ATGCGGTGCTCTACCTCACCTGTGTTGACATCTCTCTGGATTGCGACCTGAACTGTGAGG
  128   R   Q   D   R   N   F   V   D   K   R   Q   W   V   W   G   P   S   G   Y   G
  421 GAAGGCAGGACAGGAACTTTGTAGACAAGCGGCAGTGGGTCTGGGGGCCCAGTGGGTATG
  148   G   I   L   L   V   N   C   D   R   D   D   P   S   C   D   V   Q   D   N   C
  481 GCGGCATCTTGCTGGTGAACTGTGACCGTGATGATCCGAGCTGTGATGTCCAGGACAATT
  168   D   Q   H   V   H   C   L   Q   D   L   E   D   M   S   V   M   V   L   R   T
  541 GTGACCAGCACGTGCACTGCCTGCAAGACCTGGAAGACATGTCTGTCATGGTCCTGCGGA
  188   Q   G   P   A   A   L   F   D   D   H   K   L   V   L   H   T   S   S   Y   D
  601 CGCAGGGCCCTGCAGCCCTCTTTGATGACCACAAACTTGTCCTCCATACCTCCAGCTATG
  208   A   K   R   Q   V   F   H   I   C   G   P   E   D   V   C   E   A   Y   R
  661 ATGCCAAACGGGCACAGGTCTTCCACATCTGCGGTCCTGAGGATGTGTGTGAGGCCTATA
  228   H   V   L   G   Q   D   K   V   S   Y   E   V   P   R   L   H   G   D   E   E
  721 GGCATGTGCTGGGCCAAGATAAGGTGTCCTATGAGGTACCCCGCTTGCATGGGGATGAGG
  248   R   F   V   E   G   L   S   F   P   D   A   G   F   T   G   L   I   S   F
  781 AGCGCTTCTTCGTGGAAGGCCTGTCCTTCCCTGATGCCGGCTTCACAGGACTCATCTCCT
  268   H   V   T   L   L   D   D   S   N   E   D   F   S   A   S   P   I   F   T   D
  841 TCCATGTCACTCTGCTGGACGACTCCAACGAGGATTTCTCGGCATCCCCTATCTTCACTG
  288   T   V   V   F   R   V   A   P   W   I   M   T   P   S   T   L   P   P   L   E
  901 ACACTGTGGTGTTCCGAGTGGCACCCTGGATCATGACGCCCAGCACTCTGCCACCCCTAG
  308   V   Y   V   C   R   V   R   N   N   T   C   F   V   D   A   V   A   E   L   A
  961 AGGTGTATGTGTGCCGTGTGAGGAACAACACGTGTTTTGTGGATGCGGTGGCAGAGCTGG
  328   R   K   A   G   C   K   L   T   I   C   P   Q   A   E   N   R   N   D   R   W
```

Figure 2C-1

```
1021 CCAGGAAGGCCGGCTGCAAGCTGACCATCTGCCCACAGGCCGAGAACCGCAACGACCGCT
 348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
 368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
 388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
 408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
 428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
 448   D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
 468   V  G  H  V  D  E  F  L  S  F  V  P  V  P  D  K  G  F  R
1441 CCGTGGGCCATGTGGATGAGTTTCTGAGCTTTGTCCCTGTCCCCGATGGGAAGGGCTTCC
 488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
 508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
 528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
 548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
 568   D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
 588   V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
 608   N  G  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
 628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
 648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
```

Figure 2C-2

```
2461 acaaccccaaaaccagaccactccacgcaggacaggcaggagagattcttcctaaagcct
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtggggcccggttctcgaggtgtgtgccagcta
3121 cacgtgtgttctgtatgggtccagctgcgtttccatcactcgctaataaatcaacagaaa
3181 cac
```

Figure 2C-3

Figure 2D. The cDNA (SEQ ID. NO. : 8) and amino acid sequence (SEQ ID. NO. : 9) of 184P1E2 v.4. The start methionine is underlined. The open reading frame extends from nucleic acid 42-2036 including the stop codon.

```
                                                 M   S   L   Q   R   I   V
   1 gagtgttggggttggcggccacagctaagtccaacaccagcATGTCGCTGCAGAGAATCG
     8   R   V   S   L   E   H   P   T   S   A   V   C   V   A   G   V   E   T   L   V
  61 TGCGTGTGTCCCTGGAGCATCCCACCAGCGCGGTGTGTGTGGCTGGCGTGGAGACCCTCG
    28   D   I   Y   G   S   V   P   E   G   T   E   M   F   E   V   Y   G   T   P   G
 121 TGGACATTTATGGGTCAGTGCCTGAGGGCACAGAAATGTTTGAGGTCTATGGGACGCCTG
    48   V   D   I   Y   I   S   P   N   M   E   R   G   R   E   R   A   D   T   R   R
 181 GCGTGGACATCTACATCTCTCCCAACATGGAGAGGGGCCGGGAGCGTGCAGACACCAGGC
    68   W   R   F   D   A   T   L   E   I   I   V   V   M   N   S   P   S   N   D   L
 241 GGTGGCGCTTTGACGCGACTTTGGAGATCATCGTGGTCATGAACTCCCCCAGCAATGACC
    88   N   D   S   H   V   Q   I   S   Y   H   S   S   H   E   P   L   P   L   A   Y
 301 TCAACGACAGCCATGTTCAGATTTCCTACCACTCCAGCCATGAGCCTCTGCCCCTGGCCT
   108   A   V   L   Y   L   T   C   V   D   I   S   L   D   C   D   L   N   C   E   G
 361 ATGCGGTGCTCTACCTCACCTGTGTTGACATCTCTCTGGATTGCGACCTGAACTGTGAGG
   128   R   Q   D   R   N   F   V   D   K   R   Q   W   V   W   G   P   S   G   Y   G
 421 GAAGGCAGGACAGGAACTTTGTAGACAAGCGGCAGTGGGTCTGGGGGCCCAGTGGGTATG
   148   G   I   L   L   V   N   C   D   R   D   D   P   S   C   D   V   Q   D   N   C
 481 GCGGCATCTTGCTGGTGAACTGTGACCGTGATGATCCGAGCTGTGATGTCCAGGACAATT
   168   D   Q   H   V   H   C   L   Q   D   L   E   D   M   S   V   M   V   L   R   T
 541 GTGACCAGCACGTGCACTGCCTGCAAGACCTGGAAGACATGTCTGTCATGGTCCTGCGGA
   188   Q   G   P   A   A   L   F   D   D   H   K   L   V   L   H   T   S   S   Y   D
 601 CGCAGGGCCCTGCAGCCCTCTTTGATGACCACAAACTTGTCCTCCATACCTCCAGCTATG
   208   A   K   R   A   Q   V   F   H   I   C   G   P   E   D   V   C   E   A   Y   R
 661 ATGCCAAACGGGCACAGGTCTTCCACATCTGCGGTCCTGAGGATGTGTGTGAGGCCTATA
   228   H   V   L   G   Q   D   K   V   S   Y   E   V   P   R   L   H   G   D   E   E
 721 GGCATGTGCTGGGCCAAGATAAGGTGTCCTATGAGGTACCCCGCTTGCATGGGGATGAGG
   248   R   F   F   V   E   G   L   S   F   P   D   A   G   F   T   G   L   I   S   F
 781 AGCGCTTCTTCGTGGAAGGCCTGTCCTTCCCTGATGCCGGCTTCACAGGACTCATCTCCT
   268   H   V   T   L   L   D   D   S   N   E   D   F   S   A   S   P   I   F   T   D
 841 TCCATGTCACTCTGCTGGACGACTCCAACGAGGATTTCTCGGCATCCCCTATCTTCACTG
   288   T   V   V   F   R   V   A   P   W   I   M   T   P   S   T   L   P   P   L   E
 901 ACACTGTGGTGTTCCGAGTGGCACCCTGGATCATGACGCCCAGCACTCTGCCACCCCTAG
   308   V   Y   V   C   R   V   R   N   N   T   C   F   V   D   A   V   A   E   L   A
 961 AGGTGTATGTGTGCCGTGTGAGGAACAACACGTGTTTTGTGGATGCGGTGGCAGAGCTGG
   328   R   K   A   G   C   K   L   T   I   C   P   Q   A   E   N   R   N   D   R   W
1021 CCAGGAAGGCCGGCTGCAAGCTGACCATCTGCCCACAGGCCGAGAACCGCAACGACCGCT
```

Figure 2D-1

```
348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448   D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
468   V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568   D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
588   V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608   N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCGCTGGGCCTCC
628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2D-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctgggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtggggcccggttctcgaggtgtgtgccagcta
3121 cacgtgtgttctgtatgggtccagctgcgtttccatcactcgctaataaatcaacagaaa
3181 cac
```

Figure 2D-3

Figure 2E. The cDNA (SEQ ID. NO. : 10) and amino acid sequence (SEQ ID. NO. : 11) of 184P1E2 v.5. The start methionine is underlined. The open reading frame extends from nucleic acid 42-2036 including the stop codon.

```
   1                                              M  S  L  Q  R  I  V
   1 gagtgttggggttggcggccacagctaagtccaacaccagcATGTCGCTGCAGAGAATCG
   8  R  V  S  L  E  H  P  T  S  A  V  C  V  A  G  V  E  T  L  V
  61 TGCGTGTGTCCCTGGAGCATCCCACCAGCGCGGTGTGTGTGGCTGGCGTGGAGACCCTCG
  28  D  I  Y  G  S  V  P  E  G  T  E  M  F  E  V  Y  G  T  P  G
 121 TGGACATTTATGGGTCAGTGCCTGAGGGCACAGAAATGTTTGAGGTCTATGGGACGCCTG
  48  V  D  I  Y  I  S  P  N  M  E  R  G  R  E  R  A  D  T  R  R
 181 GCGTGGACATCTACATCTCTCCCAACATGGAGAGGGGCCGGGAGCGTGCAGACACCAGGC
  68  W  R  F  D  A  T  L  E  I  I  V  V  M  N  S  P  S  N  D  L
 241 GGTGGCGCTTTGACGCGACTTTGGAGATCATCGTGGTCATGAACTCCCCCAGCAATGACC
  88  N  D  S  H  V  Q  I  S  Y  H  S  S  H  E  P  L  P  L  A  Y
 301 TCAACGACAGCCATGTTCAGATTTCCTACCACTCCAGCCATGAGCCTCTGCCCCTGGCCT
 108  A  V  L  Y  L  T  C  V  D  I  S  L  D  C  D  L  N  C  E  G
 361 ATGCGGTGCTCTACCTCACCTGTGTTGACATCTCTCTGGATTGCGACCTGAACTGTGAGG
 128  R  Q  D  R  N  F  V  D  K  R  Q  W  V  W  G  P  S  G  Y  G
 421 GAAGGCAGGACAGGAACTTTGTAGACAAGCGGCAGTGGGTCTGGGGGCCCAGTGGGTATG
 148  G  I  L  L  V  N  C  D  R  D  D  P  S  C  D  V  Q  D  N  C
 481 GCGGCATCTTGCTGGTGAACTGTGACCGTGATGATCCGAGCTGTGATGTCCAGGACAATT
 168  D  Q  H  V  H  C  L  Q  D  L  E  D  M  S  V  M  V  L  R  T
 541 GTGACCAGCACGTGCACTGCCTGCAAGACCTGGAAGACATGTCTGTCATGGTCCTGCGGA
 188  Q  G  P  A  A  L  F  D  D  H  K  L  V  L  H  T  S  S  Y  D
 601 CGCAGGGCCCTGCAGCCCTCTTTGATGACCACAAACTTGTCCTCCATACCTCCAGCTATG
 208  A  K  R  A  Q  V  F  H  I  C  G  P  E  D  V  C  E  A  Y  R
 661 ATGCCAAACGGGCACAGGTCTTCCACATCTGCGGTCCTGAGGATGTGTGTGAGGCCTATA
 228  H  V  L  G  Q  D  K  V  S  Y  E  V  P  R  L  H  G  D  E  E
 721 GGCATGTGCTGGGCCAAGATAAGGTGTCCTATGAGGTACCCCGCTTGCATGGGGATGAGG
 248  R  F  F  V  E  G  L  S  F  P  D  A  G  F  T  G  L  I  S  F
 781 AGCGCTTCTTCGTGGAAGGCCTGTCCTTCCCTGATGCCGGCTTCACAGGACTCATCTCCT
 268  H  V  T  L  L  D  D  S  N  E  D  F  S  A  S  P  I  F  T  D
 841 TCCATGTCACTCTGCTGGACGACTCCAACGAGGATTTCTCGGCATCCCCTATCTTCACTG
 288  T  V  V  F  R  V  A  P  W  I  M  P  S  T  L  P  P  L  E
 901 ACACTGTGGTGTTCCGAGTGGCACCCTGGATCATGACGCCCAGCACTCTGCCACCCCTAG
 308  V  Y  V  C  R  V  R  N  N  T  C  F  V  D  A  V  A  E  L  A
 961 AGGTGTATGTGTGCCGTGTGAGGAACAACACGTGTTTTGTGGATGCGGTGGCAGAGCTGG
 328  R  K  A  G  C  K  L  T  I  C  P  Q  A  E  N  R  N  D  R  W
1021 CCAGGAAGGCCGGCTGCAAGCTGACCATCTGCCCACAGGCCGAGAACCGCAACGACCGCT
```

Figure 2E-1

```
348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448   D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
468   V  G  H  V  D  E  F  L  S  F  V  P  A  D  G  K  G  F  R
1441 CCGTGGGCCATGTGGATGAGTTTCTGAGCTTTGTCCCTGCCCCCGATGGGAAGGGCTTCC
488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568   D  I  P  Q  L  F  K  T  E  R  K  K  A  T  F  F  P  D  L
1741 TTGACATCCCACAGCTCTTCAAGACCGAGAGGAAAAAAGCAACGGCCTTCTTCCCTGACT
588   V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608   N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccctaaaaccagaccactccacgcaggacaggcaggagagattcttcctaaagcct
```

Figure 2E-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctgggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtgggggcccggttctcgaggtgtgtgccagcta
3121 cacgtgtgttctgtatgggtccagctgcgtttccatcactcgctaataaatcaacagaaa
3181 cac
```

Figure 2E-3

Figure 2F. The cDNA (SEQ ID. NO. : 12) and amino acid sequence (SEQ ID. NO. : 13) of 184P1E2 v.6. The start methionine is underlined. The open reading frame extends from nucleic acid 42-2036 including the stop codon.

```
  1                                               M   S   L   Q   R   I   V
  1 gagtgttggggttggcggccacagctaagtccaacaccagcATGTCGCTGCAGAGAATCG
  8   R   V   S   L   E   H   P   T   S   A   V   C   V   A   G   V   E   T   L   V
 61 TGCGTGTGTCCCTGGAGCATCCCACCAGCGCGGTGTGTGTGGCTGGCGTGGAGACCCTCG
 28   D   I   Y   G   S   V   P   E   G   T   E   M   F   E   V   Y   G   T   P   G
121 TGGACATTTATGGGTCAGTGCCTGAGGGCACAGAAATGTTTGAGGTCTATGGGACGCCTG
 48   V   D   I   Y   I   S   P   N   M   E   R   G   R   E   R   A   D   T   R   R
181 GCGTGGACATCTACATCTCTCCCAACATGGAGAGGGGCCGGGAGCGTGCAGACACCAGGC
 68   W   R   F   D   A   T   L   E   I   I   V   V   M   N   S   P   S   N   D   L
241 GGTGGCGCTTTGACGCGACTTTGGAGATCATCGTGGTCATGAACTCCCCCAGCAATGACC
 88   N   D   S   H   V   Q   I   S   Y   H   S   S   H   E   P   L   P   L   A   Y
301 TCAACGACAGCCATGTTCAGATTTCCTACCACTCCAGCCATGAGCCTCTGCCCCTGGCCT
108   A   V   L   Y   L   T   C   V   D   I   S   L   D   C   D   L   N   C   E   G
361 ATGCGGTGCTCTACCTCACCTGTGTTGACATCTCTCTGGATTGCGACCTGAACTGTGAGG
128   R   Q   D   R   N   F   V   D   K   R   Q   W   V   W   G   P   S   G   Y   G
421 GAAGGCAGGACAGGAACTTTGTAGACAAGCGGCAGTGGGTCTGGGGGCCCAGTGGGTATG
148   G   I   L   L   V   N   C   D   R   D   D   P   S   C   D   V   Q   D   N   C
481 GCGGCATCTTGCTGGTGAACTGTGACCGTGATGATCCGAGCTGTGATGTCCAGGACAATT
168   D   Q   H   V   H   C   L   Q   D   L   E   D   M   S   V   M   V   L   R   T
541 GTGACCAGCACGTGCACTGCCTGCAAGACCTGGAAGACATGTCTGTCATGGTCCTGCGGA
188   Q   G   P   A   A   L   F   D   D   H   K   L   V   L   H   T   S   S   Y   D
601 CGCAGGGCCCTGCAGCCCTCTTTGATGACCACAAACTTGTCCTCCATACCTCCAGCTATG
208   A   K   R   A   Q   V   F   H   I   C   G   P   E   D   V   C   E   A   Y   R
661 ATGCCAAACGGGCACAGGTCTTCCACATCTGCGGTCCTGAGGATGTGTGTGAGGCCTATA
228   H   V   L   G   Q   D   K   V   S   Y   E   V   P   R   L   H   G   D   E   E
721 GGCATGTGCTGGGCCAAGATAAGGTGTCCTATGAGGTACCCCGCTTGCATGGGGATGAGG
248   R   F   F   V   E   G   L   S   F   P   D   A   G   F   T   G   L   I   S   F
781 AGCGCTTCTTCGTGGAAGGCCTGTCCTTCCCTGATGCCGGCTTCACAGGACTCATCTCCT
268   H   V   T   L   L   D   D   S   N   E   D   F   S   A   S   P   I   F   T   D
841 TCCATGTCACTCTGCTGGACGACTCCAACGAGGATTTCTCGGCATCCCCTATCTTCACTG
288   T   V   V   F   R   V   A   P   W   I   M   T   P   S   T   L   P   P   L   E
901 ACACTGTGGTGTTCCGAGTGGCACCCTGGATCATGACGCCCAGCACTCTGCCACCCCTAG
308   V   Y   V   C   R   V   R   N   N   T   C   F   V   D   A   V   A   E   L   A
961 AGGTGTATGTGTGCCGTGTGAGGAACAACACGTGTTTTGTGGATGCGGTGGCAGAGCTGG
328   R   K   A   G   C   K   L   T   I   C   P   Q   A   E   N   R   N   D   R   W
021 CCAGGAAGGCCGGCTGCAAGCTGACCATCTGCCCACAGGCCGAGAACCGCAACGACCGCT
```

Figure 2F-1

```
348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448   D  F  L  H  A  Q  K  V  Q  P  P  V  E  L  F  V  D  W  L  A
1381 GGGACTTCCTCCATGCCCAGAAGGTGCAGCCCCCGTGGAGCTCTTTGTGGACTGGTTGG
468   V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568   D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
588   V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608   N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2F-2

```
2521 cccccataaaaagggagctgtggatccacttagatcagggcggaaccatctttcacccgg
2581 ccaagctcctgcccagatgttgaccctcacccagcgtgagctgtcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctgggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtgggggcccggttctcgaggtgtgtgccagcta
3121 cacgtgtgttctgtatgggtccagctgcgtttccatcactcgctaataaatcaacagaaa
3181 cac
```

Figure 2F-3

Figure 2G. The cDNA (SEQ ID. NO. : 14) and amino acid sequence (SEQ ID. NO. : 15) of 184P1E2 v.7. The start methionine is underlined. The open reading frame extends from nucleic acid 42-2036 including the stop codon.

```
                                              M   S   L   Q   R   I   V
   1  gagtgttggggttggcggccacagctaagtccaacaccagcATGTCGCTGCAGAGAATCG
   8   R   V   S   L   E   H   P   T   S   A   V   C   V   A   G   V   E   T   L   V
  61  TGCGTGTGTCCCTGGAGCATCCCACCAGCGCGGTGTGTGTGGCTGGCGTGGAGACCCTCG
  28   D   I   Y   G   S   V   P   E   G   T   E   M   F   E   V   Y   G   T   P   G
 121  TGGACATTTATGGGTCAGTGCCTGAGGGCACAGAAATGTTTGAGGTCTATGGGACGCCTG
  48   V   D   I   Y   I   S   P   N   M   E   R   G   R   E   A   D   T   R   R
 181  GCGTGGACATCTACATCTCTCCCAACATGGAGAGGGGCCGGGAGCGTGCAGACACCAGGC
  68   W   R   F   D   A   T   L   E   I   I   V   V   M   N   S   P   S   N   D   L
 241  GGTGGCGCTTTGACGCGACTTTGGAGATCATCGTGGTCATGAACTCCCCCAGCAATGACC
  88   N   D   S   H   V   Q   I   S   Y   H   S   S   H   E   P   L   P   L   A   Y
 301  TCAACGACAGCCATGTTCAGATTTCCTACCACTCCAGCCATGAGCCTCTGCCCCTGGCCT
 108   A   V   L   Y   L   T   C   V   D   I   S   L   D   C   D   L   N   C   E   G
 361  ATGCGGTGCTCTACCTCACCTGTGTTGACATCTCTCTGGATTGCGACCTGAACTGTGAGG
 128   R   Q   D   R   N   F   V   D   K   R   Q   W   V   W   G   P   S   G   Y   G
 421  GAAGGCAGGACAGGAACTTTGTAGACAAGCGGCAGTGGGTCTGGGGCCCAGTGGGTATG
 148   G   I   L   L   V   N   C   D   R   D   D   P   S   C   D   V   Q   D   N   C
 481  GCGGCATCTTGCTGGTGAACTGTGACCGTGATGATCCGAGCTGTGATGTCCAGGACAATT
 168   D   Q   H   V   H   C   L   Q   D   L   E   D   M   S   V   M   V   L   R   T
 541  GTGACCAGCACGTGCACTGCCTGCAAGACCTGGAAGACATGTCTGTCATGGTCCTGCGGA
 188   Q   G   P   A   A   L   F   D   D   H   K   L   V   L   H   T   S   S   Y   D
 601  CGCAGGGCCCTGCAGCCCTCTTTGATGACCACAAACTTGTCCTCCATACCTCCAGCTATG
 208   A   K   R   A   Q   V   F   H   I   C   G   P   E   D   V   C   E   A   Y   R
 661  ATGCCAAACGGGCACAGGTCTTCCACATCTGCGGTCCTGAGGATGTGTGTGAGGCCTATA
 228   H   V   L   G   Q   D   K   V   S   Y   E   V   P   R   L   H   G   D   E   E
 721  GGCATGTGCTGGGCCAAGATAAGGTGTCCTATGAGGTACCCCGCTTGCATGGGGATGAGG
 248   R   F   F   V   E   G   L   S   F   P   D   A   G   F   T   G   L   I   S   F
 781  AGCGCTTCTTCGTGGAAGGCCTGTCCTTCCCTGATGCCGGCTTCACAGGACTCATCTCCT
 268   H   V   T   L   L   D   D   S   N   E   D   F   S   A   S   P   I   F   T   D
 841  TCCATGTCACTCTGCTGGACGACTCCAACGAGGATTTCTCGGCATCCCCTATCTTCACTG
 288   T   V   V   F   R   V   A   P   W   I   M   T   P   S   T   L   P   P   L   E
 901  ACACTGTGGTGTTCCGAGTGGCACCCTGGATCATGACGCCCAGCACTCTGCCACCCCTAG
 308   V   Y   V   C   R   V   R   N   N   T   C   F   V   D   A   V   A   E   L   A
 961  AGGTGTATGTGTGCCGTGTGAGGAACAACACGTGTTTTGTGGATGCGGTGGCAGAGCTGG
 328   R   K   A   G   C   K   L   T   I   C   P   Q   A   E   N   R   N   D   R   W
1021  CCAGGAAGGCCGGCTGCAAGCTGACCATCTGCCCACAGGCCGAGAACCGCAACGACCGCT
```

Figure 2G-1

```
348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448   D  F  L  H  Q  K  V  Q  P  P  V  E  L  F  V  D  W  L  A
1381 GGGACTTCCTCCATGCCCAGAAGGTGCAGCCCCCGTGGAGCTCTTTGTGGACTGGTTGG
468   V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568   D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
588   V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608   N  G  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2G-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaatttcttggaggacgaaagtat
2761 gctggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtgggggcccggttctcgaggtgtgtgccagcta
3121 cacgtgtgttctgtatgggtccagctgcgtttccatcactcgctaataaatcaacagaaa
3181 cac
```

Figure 2G-3

Figure 2H. The cDNA (SEQ ID. NO. : 16) and amino acid sequence (SEQ ID. NO. : 17) of 184P1E2 v.8. The start methionine is underlined. The open reading frame extends from nucleic acid 42-2036 including the stop codon.

```
                                              M   S   L   Q   R   I   V
   1 gagtgttggggttggcggccacagctaagtccaacaccagcATGTCGCTGCAGAGAATCG
    8  R   V   S   L   E   H   P   T   S   A   V   C   V   A   G   V   E   T   L   V
   61 TGCGTGTGTCCCTGGAGCATCCCACCAGCGCGGTGTGTGTGGCTGGCGTGGAGACCCTCG
   28  D   I   Y   G   S   V   P   E   G   T   E   M   F   E   V   Y   G   T   P   G
  121 TGGACATTTATGGGTCAGTGCCTGAGGGCACAGAAATGTTTGAGGTCTATGGGACGCCTG
   48  V   D   I   Y   I   S   P   N   M   E   R   G   R   E   R   A   D   T   R   R
  181 GCGTGGACATCTACATCTCTCCCAACATGGAGAGGGGCCGGGAGCGTGCAGACACCAGGC
   68  W   R   F   D   A   T   L   E   I   I   V   V   M   N   S   P   S   N   D   L
  241 GGTGGCGCTTTGACGCGACTTTGGAGATCATCGTGGTCATGAACTCCCCCAGCAATGACC
   88  N   D   S   H   V   Q   I   S   Y   H   S   S   H   E   P   L   P   L   A   Y
  301 TCAACGACAGCCATGTTCAGATTTCCTACCACTCCAGCCATGAGCCTCTGCCCCTGGCCT
  108  A   V   L   Y   L   T   C   V   D   I   S   L   D   C   D   L   N   C   E   G
  361 ATGCGGTGCTCTACCTCACCTGTGTTGACATCTCTCTGGATTGCGACCTGAACTGTGAGG
  128  R   Q   D   R   N   F   V   D   K   R   Q   W   V   W   G   P   S   G   Y   G
  421 GAAGGCAGGACAGGAACTTTGTAGACAAGCGGCAGTGGGTCTGGGGGCCCAGTGGGTATG
  148  G   I   L   L   V   N   C   D   R   D   D   P   S   C   D   V   Q   D   N   C
  481 GCGGCATCTTGCTGGTGAACTGTGACCGTGATGATCCGAGCTGTGATGTCCAGGACAATT
  168  D   Q   H   V   H   C   L   Q   D   L   E   D   M   S   V   M   V   L   R   T
  541 GTGACCAGCACGTGCACTGCCTGCAAGACCTGGAAGACATGTCTGTCATGGTCCTGCGGA
  188  Q   G   P   A   A   L   F   D   D   H   K   L   V   L   H   T   S   S   Y   D
  601 CGCAGGGCCCTGCAGCCCTCTTTGATGACCACAAACTTGTCCTCCATACCTCCAGCTATG
  208  A   K   R   A   Q   V   F   H   I   C   G   P   E   D   V   C   E   A   Y   R
  661 ATGCCAAACGGGCACAGGTCTTCCACATCTGCGGTCCTGAGGATGTGTGTGAGGCCTATA
  228  H   V   L   G   Q   D   K   V   S   Y   E   V   P   R   L   H   G   D   E   E
  721 GGCATGTGCTGGGCCAAGATAAGGTGTCCTATGAGGTACCCCGCTTGCATGGGGATGAGG
  248  R   F   F   V   E   G   L   S   F   P   D   A   G   F   T   G   L   I   S   F
  781 AGCGCTTCTTCGTGGAAGGCCTGTCCTTCCCTGATGCCGGCTTCACAGGACTCATCTCCT
  268  H   V   T   L   L   D   D   S   N   E   D   F   S   A   S   P   I   F   T   D
  841 TCCATGTCACTCTGCTGGACGACTCCAACGAGGATTTCTCGGCATCCCCTATCTTCACTG
  288  T   V   V   F   R   V   A   P   W   I   M   T   P   S   T   L   P   P   L   E
  901 ACACTGTGGTGTTCCGAGTGGCACCCTGGATCATGACGCCCAGCACTCTGCCACCCCTAG
  308  V   Y   V   C   R   V   R   N   N   T   C   F   V   D   A   V   A   E   L   A
  961 AGGTGTATGTGTGCCGTGTGAGGAACAACACGTGTTTTGTGGATGCGGTGGCAGAGCTGG
  328  R   K   A   G   C   K   L   T   I   C   P   Q   A   E   N   R   N   D   R   W
 1021 CCAGGAAGGCCGGCTGCAAGCTGACCATCTGCCCACAGGCCGAGAACCGCAACGACCGCT
```

Figure 2H-1

```
348  I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368  F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388  D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408  G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428  I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448  D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
468  V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488  M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508  H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528  I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548  I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568  D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
588  V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
608  N  G  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628  C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648  T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2H-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaccgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtgggggcccggttctcgaggtgtgtgccagcta
3121 cacgtgtgttctgtatgggtccagctgcgtttccatcactcgctaataaatcaacagaaa
3181 cac
```

Figure 2H-3

Figure 2I. The cDNA (SEQ ID. NO. : 18) and amino acid sequence (SEQ ID. NO. : 19) of 184P1E2 v.9. The start methionine is underlined. The open reading frame extends from nucleic acid 42-2036 including the stop codon.

```
1                                              M   S   L   Q   R   I   V
   1 gagtgttgggggttggcggccacagctaagtccaacaccagcATGTCGCTGCAGAGAATCG
   8   R   V   S   L   E   H   P   T   S   A   V   C   V   A   G   V   E   T   L   V
  61 TGCGTGTGTCCCTGGAGCATCCCACCAGCGCGGTGTGTGTGGCTGGCGTGGAGACCCTCG
  28   D   I   Y   G   S   V   P   E   G   T   E   M   F   E   V   Y   G   T   P   G
 121 TGGACATTTATGGGTCAGTGCCTGAGGGCACAGAAATGTTTGAGGTCTATGGGACGCCTG
  48   V   D   I   Y   I   S   P   N   M   E   R   G   R   E   A   D   T   R   R
 181 GCGTGGACATCTACATCTCTCCCAACATGGAGAGGGGCCGGGAGCGTGCAGACACCAGGC
  68   W   R   F   D   A   T   L   E   I   I   V   V   M   N   S   P   S   N   D   L
 241 GGTGGCGCTTTGACGCGACTTTGGAGATCATCGTGGTCATGAACTCCCCCAGCAATGACC
  88   N   D   S   H   V   Q   I   S   Y   H   S   S   H   E   P   L   P   L   A   Y
 301 TCAACGACAGCCATGTTCAGATTTCCTACCACTCCAGCCATGAGCCTCTGCCCCTGGCCT
 108   A   V   L   Y   L   T   C   V   D   I   S   L   D   C   D   L   N   C   E   G
 361 ATGCGGTGCTCTACCTCACCTGTGTTGACATCTCTCTGGATTGCGACCTGAACTGTGAGG
 128   R   Q   D   R   N   F   V   D   K   R   Q   W   V   W   G   P   S   G   Y   G
 421 GAAGGCAGGACAGGAACTTTGTAGACAAGCGGCAGTGGGTCTGGGGGCCCAGTGGGTATG
 148   G   I   L   L   V   N   C   D   R   D   D   P   S   C   D   V   Q   D   N   C
 481 GCGGCATCTTGCTGGTGAACTGTGACCGTGATGATCCGAGCTGTGATGTCCAGGACAATT
 168   D   Q   H   V   H   C   L   Q   D   L   E   D   M   S   V   M   V   L   R   T
 541 GTGACCAGCACGTGCACTGCCTGCAAGACCTGGAAGACATGTCTGTCATGGTCCTGCGGA
 188   Q   G   P   A   A   L   F   D   D   H   K   L   V   L   H   T   S   S   Y   D
 601 CGCAGGGCCCTGCAGCCCTCTTTGATGACCACAAACTTGTCCTCCATACCTCCAGCTATG
 208   A   K   R   A   Q   V   F   H   I   C   G   P   E   D   V   C   E   A   Y   R
 661 ATGCCAAACGGGCACAGGTCTTCCACATCTGCGGTCCTGAGGATGTGTGTGAGGCCTATA
 228   H   V   L   G   Q   D   K   V   S   Y   E   V   P   R   L   H   G   D   E   E
 721 GGCATGTGCTGGGCCAAGATAAGGTGTCCTATGAGGTACCCCGCTTGCATGGGGATGAGG
 248   R   F   F   V   E   G   L   S   F   P   D   A   G   F   T   G   L   I   S   F
 781 AGCGCTTCTTCGTGGAAGGCCTGTCCTTCCCTGATGCCGGCTTCACAGGACTCATCTCCT
 268   H   V   T   L   L   D   D   S   N   E   D   F   S   A   S   P   I   F   T   D
 841 TCCATGTCACTCTGCTGGACGACTCCAACGAGGATTTCTCGGCATCCCCTATCTTCACTG
 288   T   V   V   F   R   V   A   P   W   I   M   T   P   S   T   L   P   P   L   E
 901 ACACTGTGGTGTTCCGAGTGGCACCCTGGATCATGACGCCCAGCACTCTGCCACCCCTAG
 308   V   Y   V   C   R   V   R   N   N   T   C   F   V   D   A   V   A   E   L   A
 961 AGGTGTATGTGTGCCGTGTGAGGAACAACACGTGTTTTGTGGATGCGGTGGCAGAGCTGG
 328   R   K   A   G   C   K   L   T   I   C   P   Q   A   E   N   R   N   D   R   W
1021 CCAGGAAGGCCGGCTGCAAGCTGACCATCTGCCCACAGGCCGAGAACCGCAACGACCGCT
```

Figure 2I-1

```
348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
428   I  L  I  G  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
448   D  F  L  H  A  Q  K  V  Q  P  P  V  E  L  F  V  D  W  L  A
1381 GGGACTTCCTCCATGCCCAGAAGGTGCAGCCCCCCGTGGAGCTCTTTGTGGACTGGTTGG
468   V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
488   M  L  L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
508   H  G  R  A  L  L  F  Q  G  V  V  D  D  E  Q  V  K  T  I  S
1561 GCCACGGGAGGGCCCTCCTGTTCCAGGGGGTTGTTGATGATGAGCAGGTCAAGACCATCT
528   I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
548   I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
568   D  I  P  Q  L  F  K  T  E  R  K  K  A  F  F  P  D  L
1741 TTGACATCCCACAGCTCTTCAAGACCGAGAGGAAAAAAGCAACGGCCTTCTTCCCTGACT
588   V  N  M  L  V  L  G  K  H  L  G  I  P  K  F  G  P  I  I
1801 TGGTGAACATGCTGGTGCTGGGGAAGCACCTGGGCATCCCCAAGCCCTTTGGGCCCATCA
608   N  G  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
628   C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
648   T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtcccctggggcgggcattggccaggtggtggagacagaga
2101 caggccctgaacgataagcaccaagagacccaaggctccagatggaacactgagggtgac
2161 cgtccctctcagaagcttttcctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
```

Figure 2I-2

```
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctgggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagagggggctaaggggctggatccaccaaggcagctcacagcgggaaaactctgggaa
3061 tgaaccactgaattcaggggatggggtggggcccggttctcgaggtgtgtgccagcta
3121 cacgtgtgttctgtatgggtccagctgcgtttccatcactcgctaataaatcaacagaaa
3181 cac
```

Figure 2I-3

Figure 2J. The cDNA (SEQ ID. NO.: 20) and amino acid sequence (SEQ ID. NO.: 21) of 184P1E2 v.10. The start methionine is underlined. The open reading frame extends from nucleic acid 42-2036 including the stop codon.

```
  1                                              M  S  L  Q  R  I  V
  1 gagtgttggggttggcggccacagctaagtccaacaccagcATGTCGCTGCAGAGAATCG
  8  R  V  S  L  E  H  P  T  S  A  V  C  V  A  G  V  E  T  L  V
 61 TGCGTGTGTCCCTGGAGCATCCCACCAGCGCGGTGTGTGTGGCTGGCGTGGAGACCCTCG
 28  D  I  Y  G  S  V  P  E  G  T  E  M  F  E  V  Y  G  T  P  G
121 TGGACATTTATGGGTCAGTGCCTGAGGGCACAGAAATGTTTGAGGTCTATGGGACGCCTG
 48  V  D  I  Y  I  S  P  N  M  E  R  G  R  E  R  A  D  T  R  R
181 GCGTGGACATCTACATCTCTCCCAACATGGAGAGGGGCCGGGAGCGTGCAGACACCAGGC
 68  W  R  F  D  A  T  L  E  I  I  V  V  M  N  S  P  S  N  D  L
241 GGTGGCGCTTTGACGCGACTTTGGAGATCATCGTGGTCATGAACTCCCCCAGCAATGACC
 88  N  D  S  H  V  Q  I  S  Y  H  S  S  H  E  P  L  P  L  A  Y
301 TCAACGACAGCCATGTTCAGATTTCCTACCACTCCAGCCATGAGCCTCTGCCCCTAGCCT
108  A  V  L  Y  L  T  C  V  D  I  S  L  D  C  D  L  N  C  E  G
```

Figure 2J-1

```
 361 ATGCGGTGCTCTACCTCACCTGTGTTGACATCTCTCTGGATTGCGACCTGAACTGTGAGG
 128   R  Q  D  R  N  F  V  D  K  R  Q  W  V  W  G  P  S  G  Y  G
 421 GAAGGCAGGACAGGAACTTTGTAGACAAGCGGCAGTGGGTCTGGGGGCCCAGTGGGTATG
 148   G  I  L  L  V  N  C  D  R  D  D  P  S  C  D  V  Q  D  N  C
 481 GCGGCATCTTGCTGGTGAACTGTGACCGTGATGATCCGAGCTGTGATGTCCAGGACAATT
 168   D  Q  H  V  H  C  L  Q  D  L  E  D  M  S  V  M  V  L  R  T
 541 GTGACCAGCACGTGCACTGCCTGCAAGACCTGGAAGACATGTCTGTCATGGTCCTGCGGA
 188   Q  G  P  A  A  L  F  D  D  H  K  L  V  L  H  T  S  S  Y  D
 601 CGCAGGGCCCTGCAGCCCTCTTTGATGACCACAAACTTGTCCTCCATACCTCCAGCTATG
 208   A  K  R  A  Q  V  F  H  I  C  G  P  E  D  V  C  E  A  Y  R
 661 ATGCCAAACGGGCACAGGTCTTCCACATCTGCGGTCCTGAGGATGTGTGTGAGGCCTATA
 228   H  V  L  G  Q  D  K  V  S  Y  E  V  P  R  L  H  G  D  E  E
 721 GGCATGTGCTGGGCCAAGATAAGGTGTCCTATGAGGTACCCCGCTTGCATGGGGATGAGG
 248   R  F  F  V  E  G  L  S  F  P  D  A  G  F  T  G  L  I  S  F
 781 AGCGCTTCTTCGTGGAAGGCCTGTCCTTCCCTGATGCCGGCTTCACAGGACTCATCTCCT
 268   H  V  T  L  L  D  D  S  N  E  D  F  S  A  S  P  I  F  T  D
 841 TCCATGTCACTCTGCTGGACGACTCCAACGAGGATTTCTCGGCATCCCCTATCTTCACTG
 288   T  V  V  F  R  V  A  P  W  I  M  P  S  T  L  P  P  L  E
 901 ACACTGTGGTGTTCCGAGTGGCACCCTGGATCATGACGCCCAGCACTCTGCCACCCCTAG
 308   V  Y  V  C  R  V  R  N  N  T  C  F  V  D  A  V  A  E  L  A
 961 AGGTGTATGTGTGCCGTGTGAGGAACAACACGTGTTTTGTGGATGCGGTGGCAGAGCTGG
 328   R  K  A  G  C  K  L  T  I  C  P  Q  A  E  N  R  N  D  R  W
1021 CCAGGAAGGCCGGCTGCAAGCTGACCATCTGCCCACAGGCCGAGAACCGCAACGACCGCT
 348   I  Q  D  E  M  E  L  G  Y  V  Q  A  P  H  K  T  L  P  V  V
1081 GGATCCAGGATGAGATGGAGCTGGGCTACGTTCAGGCGCCGCACAAGACCCTCCCGGTGG
 368   F  D  S  P  R  N  G  E  L  Q  D  F  P  Y  K  R  I  L  G  P
1141 TCTTTGACTCCCCAAGGAATGGGGAACTGCAGGATTTCCCTTACAAAAGAATCCTGGGTC
 388   D  F  G  Y  V  T  R  E  P  R  D  R  S  V  S  G  L  D  S  F
1201 CAGATTTTGGTTACGTGACTCGGGAACCACGCGACAGGTCTGTGAGTGGCCTGGACTCCT
 408   G  N  L  E  V  S  P  P  V  V  A  N  G  K  E  Y  P  L  G  R
1261 TTGGGAACCTGGAGGTCAGCCCTCCAGTGGTGGCCAATGGGAAAGAGTACCCCCTGGGGA
 428   I  L  I  G  N  L  P  G  S  S  G  R  R  V  T  Q  V  V  R
1321 GGATCCTCATTGGGGGCAACCTGCCTGGGTCAAGTGGCCGCAGGGTCACCCAGGTGGTGC
 448   D  F  L  H  A  Q  K  V  Q  P  P  V  E  L  F  V  D  W  L  A
1381 GGGACTTCCTCCATGCCCAGAAGGTGCAGCCCCCGTGGAGCTCTTTGTGGACTGGTTGG
 468   V  G  H  V  D  E  F  L  S  F  V  P  A  P  D  G  K  G  F  R
1441 CCGTGGGCCATGTGGATGAGTTTCTGAGCTTTGTCCCTGCCCCCGATGGGAAGGGCTTCC
 488   M .L  A  S  P  G  A  C  F  K  L  F  Q  E  K  Q  K  C  G
1501 GGATGCTCCTGGCCAGCCCTGGGGCCTGCTTCAAGCTCTTCCAGGAAAAGCAGAAGTGTG
 508   H  G  R  A  L  L  F  Q  G  V  V  D  D  E  Q  V  K  T  I  S
```

Figure 2J-2

```
1561 GCCACGGGAGGGCCCTCCTGTTCCAGGGGGTTGTTGATGATGAGCAGGTCAAGACCATCT
 528    I  N  Q  V  L  S  N  K  D  L  I  N  Y  N  K  F  V  Q  S  C
1621 CCATCAACCAGGTGCTCTCCAATAAAGACCTCATCAACTACAATAAGTTTGTGCAGAGCT
 548    I  D  W  N  R  E  V  L  K  R  E  L  G  L  A  E  C  D  I  I
1681 GCATCGACTGGAACCGTGAGGTGCTGAAGCGGGAGCTGGGCCTGGCAGAGTGTGACATCA
 568    D  I  P  Q  L  F  K  T  E  R  K  K  A  T  A  F  F  P  D  L
1741 TTGACATCCCACAGCTCTTCAAGACCGAGAGGAAAAAAGCAACGGCCTTCTTCCCTGACT
 588    V  N  M  L  V  L  G  K  H  L  G  I  P  K  P  F  G  P  I  I
1801 TGGTGAACATGCTGGTGCTGGGGAAGCACCTGGGCATCCCCAAGCCCTTTGGGCCCATCA
 608    N  G  C  C  C  L  E  E  K  V  R  S  L  L  E  P  L  G  L  H
1861 TCAATGGCTGCTGCTGCCTGGAGGAGAAGGTGCGGTCCCTGCTGGAGCCTCTGGGCCTCC
 628    C  T  F  I  D  D  F  T  P  Y  H  M  L  H  G  E  V  H  C  G
1921 ACTGCACCTTCATTGATGACTTCACTCCATACCACATGCTGCATGGGGAGGTGCACTGTG
 648    T  N  V  C  R  K  P  F  S  F  K  W  W  N  M  V  P  *
1981 GCACCAATGTGTGCAGAAAGCCCTTCTCTTTCAAGTGGTGGAACATGGTGCCCTGAgaca
2041 gctcccacccaccatcctgtccccctggggcgggcattggccaggtggtggagacagaga
2101 caggccctgaacgataagcaccaagagacccaaggctccagatggaacactgagggtgac
2161 cgtccctctcagaagcttttccctggagtgtcatgcctcacctgcaacccatgtggttct
2221 cagacttgaatcttctcggcccccaaaaatgaaggacctcatttcttatagcctctcctg
2281 tgattcaacacaacccatggagatgtccccttctcactctgaaatcatccatttggggac
2341 aaatccacattggggtctagaaacatccacgtatctcatcagccatcttgtcctgtgcat
2401 cctaacagaggaaggatccatgattctgctttggtccaattgcttcctctctgcagagga
2461 acaaccccaaaaccagaccactccacgcaggacaggcaggagagattcttcctaaagcct
2521 cccccataaaaagggagctgtggatccacttagatcagggcggaaccatctttcacccgg
2581 ccaagctcctgcccagatgttgaccctcacccagcgtgagctttcacatagtaggagctt
2641 ctagatgcatgtggaagcaatgagagttgtcccttagccttataaactccccatgatctg
2701 acatgcagaaatccagccttgtccagaatcctcctggaattgcttggaggacgaaagtat
2761 gctggggatgggtgggtactagggagactgggtacaagggtgaaaagtagttcccataa
2821 tacacatggttgactatggtgatccaccttgtgatggttaatattaggtgtctggagaag
2881 gttgcttcattggccctgggacttctctctgcaggaggagagaacgctgcctctcctctg
2941 gattggtctcaggctctctgttggcctttggtcagcgtttccacatcctgctctgctgca
3001 ggagaggggctaaggggctggatccaccaaggcagctcacagcgggaaaactctgggac
3061 tgaaccactgaattcaggggatgggggtggggcccggttctcgaggtgtgtgccagcta
3121 cacgtgtgttctgtatgggtccagctgcgtttccatcactcgctaataaatcaacagaaa
3181 cac
```

Figure 2J-3

Figure 3A. Amino acid sequence of 184P1E2 v.1 (SEQ ID. NO. : 3). The 184P1E2 v.1 protein has 664 amino acids.

```
  1 MSLQRIVRVS LEHPTSAVCV AGVETLVDIY GSVPEGTEMF EVYGTPGVDI YISPNMERGR
 61 ERADTRRWRF DATLEIIVVM NSPSNDLNDS HVQISYHSSH EPLPLAYAVL YLTCVDISLD
121 CDLNCEGRQD RNFVDKRQWV WGPSGYGGIL LVNCDRDDPS CDVQDNCDQH VHCLQDLEDM
181 SVMVLRTQGP AALFDDHKLV LHTSSYDAKR AQVFHICGPE DVCEAYRHVL GQDKVSYEVP
241 RLHGDEERFF VEGLSFPDAG FTGLISFHVT LLDDSNEDFS ASPIFTDTVV FRVAPWIMTP
301 STLPPLEVYV CRVRNNTCFV DAVAELARKA GCKLTICPQA ENRNDRWIQD EMELGYVQAP
361 HKTLPVVFDS PRNGELQDFP YKRILGPDFG YVTREPRDRS VSGLDSFGNL EVSPPVVANG
421 KEYPLGRILI GGNLPGSSGR RVTQVVRDFL HAQKVQPPVE LFVDWLAVGH VDEFLSFVPA
481 PDGKGFRMLL ASPGACFKLF QEKQKCGHGR ALLFQGVVDD EQVKTISINQ VLSNKDLINY
541 NKFVQSCIDW NREVLKRELG LAECDIIDIP QLFKTERKKA TAFFPDLVNM LVLGKHLGIP
601 KPFGPIINGC CCLEEKVRSL LEPLGLHCTF IDDFTPYHML HGEVHCGTNV CRKPFSFKWW
661 NMVP
```

Figure 3B. Amino acid sequence of 184P1E2 v.2 (SEQ ID. NO. : 5). The 184P1E2 v.2 protein has 664 amino acids.

```
  1 MSLQRIVRVS LEHPTSAVCV AGVETLVDIY GSVPEGTEMF EVYGTPGVDI YISPNMERGR
 61 ERADTRRWRF DATLEIIVVM NSPSNDLNDS HVQISYHSSH EPLPLAYAVL YLTCVDISLD
121 CDLNCEGRQD RNFVDKRQWV WGPSGYGGIL LVNCDRDDPS CDVQDNCDQH VHCLQDLEDM
181 SVMVLRTQGP AALFDDHKLV LHTSSYDAKR AQVFHICGPE DVCEAYRHVL GQDKVSYEVP
241 RLHGDEERFF VEGLSFPDAG FTGLISFHVT LLDDSNEDFS ASPIFTDTVV FRVAPWIMTP
301 STLAPLEVYV CRVRNNTCFV DAVAELARKA GCKLTICPQA ENRNDRWIQD EMELGYVQAP
361 HKTLPVVFDS PRNGELQDFP YKRILGPDFG YVTREPRDRS VSGLDSFGNL EVSPPVVANG
421 KEYPLGRILI GGNLPGSSGR RVTQVVRDFL HAQKVQPPVE LFVDWLAVGH VDEFLSFVPA
481 PDGKGFRMLL ASPGACFKLF QEKQKCGHGR ALLFQGVVDD EQVKTISINQ VLSNKDLINY
541 NKFVQSCIDW NREVLKRELG LAECDIIDIP QLFKTERKKA TAFFPDLVNM LVLGKHLGIP
601 KPFGPIINGC CCLEEKVRSL LEPLGLHCTF IDDFTPYHML HGEVHCGTNV CRKPFSFKWW
661 NMVP
```

Figure 3C. Amino acid sequence of 184P1E2 v.3 (SEQ ID. NO. : 7). The 184P1E2 v.3 protein has 664 amino acids.

```
  1 MSLQRIVRVS LEHPTSAVCV AGVETLVDIY GSVPEGTEMF EVYGTPGVDI YISPNMERGR
 61 ERADTRRWRF DATLEIIVVM NSPSNDLNDS HVQISYHSSH EPLPLAYAVL YLTCVDISLD
121 CDLNCEGRQD RNFVDKRQWV WGPSGYGGIL LVNCDRDDPS CDVQDNCDQH VHCLQDLEDM
181 SVMVLRTQGP AALFDDHKLV LHTSSYDAKR AQVFHICGPE DVCEAYRHVL GQDKVSYEVP
241 RLHGDEERFF VEGLSFPDAG FTGLISFHVT LLDDSNEDFS ASPIFTDTVV FRVAPWIMTP
301 STLPPLEVYV CRVRNNTCFV DAVAELARKA GCKLTICPQA ENRNDRWIQD EMELGYVQAP
361 HKTLPVVFDS PRNGELQDFP YKRILGPDFG YVTREPRDRS VSGLDSFGNL EVSPPVVANG
421 KEYPLGRILI GGNLPGSSGR RVTQVVRDFL HAQKVQPPVE LFVDWLAVGH VDEFLSFVPV
481 PDGKGFRMLL ASPGACFKLF QEKQKCGHGR ALLFQGVVDD EQVKTISINQ VLSNKDLINY
541 NKFVQSCIDW NREVLKRELG LAECDIIDIP QLFKTERKKA TAFFPDLVNM LVLGKHLGIP
601 KPFGPIINGC CCLEEKVRSL LEPLGLHCTF IDDFTPYHML HGEVHCGTNV CRKPFSFKWW
661 NMVP
```

Figure 4A. Nucleic acid sequence alignment of 184P1E2 v.1 with human peptidylarginine deiminase type III. The nucleic acid differences are underlined.

```
Score = 6294 bits (3175), Expect = 0.0
Identities = 3181/3183 (99%)
Strand = Plus / Plus Query: 1     gagtgttggggttggcggccacagctaagtccaacaccagcatgtcgctgcagagaatcg 60
             ||||||||||||||||||||||||||||||||||||||||||||||||||||||||||||
Sbjct: 1     gagtgttggggttggcggccacagctaagtccaacaccagcatgtcgctgcagagaatcg 60

Query: 61    tgcgtgtgtccctggagcatcccaccagcgcggtgtgtgtggctggcgtggagaccctcg 120
             ||||||||||||||||||||||||||||||||||||||||||||||||||||||||||||
Sbjct: 61    tgcgtgtgtccctggagcatcccaccagcgcggtgtgtgtggctggcgtggagaccctcg 120

Query: 121   tggacatttatgggtcagtgcctgagggcacagaaatgtttgaggtctatgggacgcctg 180
             ||||||||||||||||||||||||||||||||||||||||||||||||||||||||||||
Sbjct: 121   tggacatttatgggtcagtgcctgagggcacagaaatgtttgaggtctatgggacgcctg 180

Query: 181   gcgtggacatctacatctctcccaacatggagaggggccgggagcgtgcagacaccaggc 240
             ||||||||||||||||||||||||||||||||||||||||||||||||||||||||||||
Sbjct: 181   gcgtggacatctacatctctcccaacatggagaggggccgggagcgtgcagacaccaggc 240

Query: 241   ggtggcgctttgacgcgactttggagatcatcgtggtcatgaactcccccagcaatgacc 300
             ||||||||||||||||||||||||||||||||||||||||||||||||||||||||||||
Sbjct: 241   ggtggcgctttgacgcgactttggagatcatcgtggtcatgaactcccccagcaatgacc 300

Query: 301   tcaacgacagccatgttcagatttcctaccactccagccatgagcctctgcccctggcct 360
             ||||||||||||||||||||||||||||||||||||||||||||||||||||||||  ||
Sbjct: 301   tcaacgacagccatgttcagatttcctaccactccagccatgagcctctgccccta_gcct 360

Query: 361   atgcggtgctctacctcacctgtgttgacatctctctggattgcgacctgaactgtgagg 420
             ||||||||||||||||||||||||||||||||||||||||||||||||||||||||||||
Sbjct: 361   atgcggtgctctacctcacctgtgttgacatctctctggattgcgacctgaactgtgagg 420

Query: 421   gaaggcaggacaggaactttgtagacaagcggcagtgggtctgggggcccagtgggtatg 480
             ||||||||||||||||||||||||||||||||||||||||||||||||||||||||||||
Sbjct: 421   gaaggcaggacaggaactttgtagacaagcggcagtgggtctgggggcccagtgggtatg 480

Query: 481   gcggcatcttgctggtgaactgtgaccgtgatgatccgagctgtgatgtccaggacaatt 540
             ||||||||||||||||||||||||||||||||||||||||||||||||||||||||||||
Sbjct: 481   gcggcatcttgctggtgaactgtgaccgtgatgatccgagctgtgatgtccaggacaatt 540

Query: 541   gtgaccagcacgtgcactgcctgcaagacctggaagacatgtctgtcatggtcctgcgga 600
             ||||||||||||||||||||||||||||||||||||||||||||||||||||||||||||
Sbjct: 541   gtgaccagcacgtgcactgcctgcaagacctggaagacatgtctgtcatggtcctgcgga 600

Query: 601   cgcagggccctgcagccctctttgatgaccacaaacttgtcctccatacctccagctatg 660
             ||||||||||||||||||||||||||||||||||||||||||||||||||||||||||||
Sbjct: 601   cgcagggccctgcagccctctttgatgaccacaaacttgtcctccatacctccagctatg 660

Query: 661   atgccaaacgggcacaggtcttccacatctgcggtcctgaggatgtgtgtgaggcctata 720
             ||||||||||||||||||||||||||||||||||||||||||||||||||||||||||||
```

Figure 4A-1

```
Sbjct:  661  atgccaaacgggcacaggtcttccacatctgcggtcctgaggatgtgtgtgaggcctata  720

Query:  721  ggcatgtgctgggccaagataaggtgtcctatgaggtaccccgcttgcatggggatgagg  780
             ||||||||||||||||||||||||||||||||||||||||||||||||||||||||||||
Sbjct:  721  ggcatgtgctgggccaagataaggtgtcctatgaggtaccccgcttgcatggggatgagg  780

Query:  781  agcgcttcttcgtggaaggcctgtccttccctgatgccggcttcacaggactcatctcct  840
             ||||||||||||||||||||||||||||||||||||||||||||||||||||||||||||
Sbjct:  781  agcgcttcttcgtggaaggcctgtccttccctgatgccggcttcacaggactcatctcct  840

Query:  841  tccatgtcactctgctggacgactccaacgaggatttctcggcatccctatcttcactg   900
             ||||||||||||||||||||||||||||||||||||||||||||||||||||||||||||
Sbjct:  841  tccatgtcactctgctggacgactccaacgaggatttctcggcatccctatcttcactg   900

Query:  901  acactgtggtgttccgagtggcaccctggatcatgacgcccagcactctgccacccctag  960
             ||||||||||||||||||||||||||||||||||||||||||||||||||||||||||||
Sbjct:  901  acactgtggtgttccgagtggcaccctggatcatgacgcccagcactctgccacccctag  960

Query:  961  aggtgtatgtgtgccgtgtgaggaacaacacgtgttttgtggatgcggtggcagagctgg  1020
             ||||||||||||||||||||||||||||||||||||||||||||||||||||||||||||
Sbjct:  961  aggtgtatgtgtgccgtgtgaggaacaacacgtgttttgtggatgcggtggcagagctgg  1020

Query: 1021  ccaggaaggccggctgcaagctgaccatctgcccacaggccgagaaccgcaacgaccgct  1080
             ||||||||||||||||||||||||||||||||||||||||||||||||||||||||||||
Sbjct: 1021  ccaggaaggccggctgcaagctgaccatctgcccacaggccgagaaccgcaacgaccgct  1080

Query: 1081  ggatccaggatgagatggagctgggctacgttcaggcgccgcacaagaccctcccggtgg  1140
             ||||||||||||||||||||||||||||||||||||||||||||||||||||||||||||
Sbjct: 1081  ggatccaggatgagatggagctgggctacgttcaggcgccgcacaagaccctcccggtgg  1140

Query: 1141  tctttgactccccaaggaatggggaactgcaggatttcccttacaaaagaatcctgggtc  1200
             ||||||||||||||||||||||||||||||||||||||||||||||||||||||||||||
Sbjct: 1141  tctttgactccccaaggaatggggaactgcaggatttcccttacaaaagaatcctgggtc  1200

Query: 1201  cagattttggttacgtgactcgggaaccacgcgacaggtctgtgagtggcctggactcct  1260
             ||||||||||||||||||||||||||||||||||||||||||||||||||||||||||||
Sbjct: 1201  cagattttggttacgtgactcgggaaccacgcgacaggtctgtgagtggcctggactcct  1260

Query: 1261  ttgggaacctggaggtcagccctccagtggtggccaatgggaaagagtaccccctgggga  1320
             ||||||||||||||||||||||||||||||||||||||||||||||||||||||||||||
Sbjct: 1261  ttgggaacctggaggtcagccctccagtggtggccaatgggaaagagtaccccctgggga  1320

Query: 1321  ggatcctcattgggggcaacctgcctgggtcaagtggccgcagggtcacccaggtggtgc  1380
             ||||||||||||||||||||||||||||||||||||||||||||||||||||||||||||
Sbjct: 1321  ggatcctcattgggggcaacctgcctgggtcaagtggccgcagggtcacccaggtggtgc  1380

Query: 1381  gggacttcctccatgcccagaaggtgcagccccgtggagctctttgtggactggttgg    1440
             ||||||||||||||||||||||||||||||||||||||||||||||||||||||||||||
Sbjct: 1381  gggacttcctccatgcccagaaggtgcagccccgtggagctctttgtggactggttgg    1440

Query: 1441  ccgtgggccatgtggatgagtttctgagctttgtccctgccccgatgggaagggcttcc   1500
```

Figure 4A-2

```
             ||||||||||||||||||||||||||||||||||||||| |||||||||||||||||||
Sbjct: 1441  ccgtgggccatgtggatgagtttctgagctttgtccctgtccccgatgggaagggcttcc 1500

Query: 1501  ggatgctcctggccagccctggggcctgcttcaagctcttccaggaaaagcagaagtgtg 1560
             ||||||||||||||||||||||||||||||||||||||||||||||||||||||||||||
Sbjct: 1501  ggatgctcctggccagccctggggcctgcttcaagctcttccaggaaaagcagaagtgtg 1560

Query: 1561  gccacggagggccctcctgttccagggggttgttgatgatgagcaggtcaagaccatct 1620
             ||||||||||||||||||||||||||||||||||||||||||||||||||||||||||||
Sbjct: 1561  gccacggagggccctcctgttccagggggttgttgatgatgagcaggtcaagaccatct 1620

Query: 1621  ccatcaaccaggtgctctccaataaagacctcatcaactacaataagtttgtgcagagct 1680
             ||||||||||||||||||||||||||||||||||||||||||||||||||||||||||||
Sbjct: 1621  ccatcaaccaggtgctctccaataaagacctcatcaactacaataagtttgtgcagagct 1680

Query: 1681  gcatcgactggaaccgtgaggtgctgaagcgggagctgggcctggcagagtgtgacatca 1740
             ||||||||||||||||||||||||||||||||||||||||||||||||||||||||||||
Sbjct: 1681  gcatcgactggaaccgtgaggtgctgaagcgggagctgggcctggcagagtgtgacatca 1740

Query: 1741  ttgacatcccacagctcttcaagaccgagaggaaaaaagcaacggccttcttccctgact 1800
             ||||||||||||||||||||||||||||||||||||||||||||||||||||||||||||
Sbjct: 1741  ttgacatcccacagctcttcaagaccgagaggaaaaaagcaacggccttcttccctgact 1800

Query: 1801  tggtgaacatgctggtgctggggaagcacctgggcatccccaagccctttgggcccatca 1860
             ||||||||||||||||||||||||||||||||||||||||||||||||||||||||||||
Sbjct: 1801  tggtgaacatgctggtgctggggaagcacctgggcatccccaagccctttgggcccatca 1860

Query: 1861  tcaatggctgctgctgcctggaggagaaggtgcggtccctgctggagcctctgggcctcc 1920
             ||||||||||||||||||||||||||||||||||||||||||||||||||||||||||||
Sbjct: 1861  tcaatggctgctgctgcctggaggagaaggtgcggtccctgctggagcctctgggcctcc 1920

Query: 1921  actgcaccttcattgatgacttcactccataccacatgctgcatggggaggtgcactgtg 1980
             ||||||||||||||||||||||||||||||||||||||||||||||||||||||||||||
Sbjct: 1921  actgcaccttcattgatgacttcactccataccacatgctgcatggggaggtgcactgtg 1980

Query: 1981  gcaccaatgtgtgcagaaagcccttctctttcaagtggtggaacatggtgccctgagaca 2040
             ||||||||||||||||||||||||||||||||||||||||||||||||||||||||||||
Sbjct: 1981  gcaccaatgtgtgcagaaagcccttctctttcaagtggtggaacatggtgccctgagaca 2040

Query: 2041  gctcccacccaccatcctgtcccctggggcgggcattggccaggtggtggagacagaga 2100
             ||||||||||||||||||||||||||||||||||||||||||||||||||||||||||||
Sbjct: 2041  gctcccacccaccatcctgtcccctggggcgggcattggccaggtggtggagacagaga 2100

Query: 2101  caggccctgaacgataagcaccaagagacccaaggctccagatggaacactgagggtgac 2160
             ||||||||||||||||||||||||||||||||||||||||||||||||||||||||||||
Sbjct: 2101  caggccctgaacgataagcaccaagagacccaaggctccagatggaacactgagggtgac 2160

Query: 2161  cgtccctctcagaagcttttccctggagtgtcatgcctcacctgcaacccatgtggttct 2220
             ||||||||||||||||||||||||||||||||||||||||||||||||||||||||||||
Sbjct: 2161  cgtccctctcagaagcttttccctggagtgtcatgcctcacctgcaacccatgtggttct 2220
```

Figure 4A-3

```
Query: 3001 ggagaggggggctaaggggctggatccaccaaggcagctcacagcgggaaaactctgggac 3060
             ||||||||||||||||||||||||||||||||||||||||||||||||||||||||||||
Sbjct: 3001 ggagaggggggctaaggggctggatccaccaaggcagctcacagcgggaaaactctgggac 3060

Query: 3061 tgaaccactgaattcaggggatgggggtgggggcccggttctcgaggtgtgtgccagcta 3120
             ||||||||||||||||||||||||||||||||||||||||||||||||||||||||||||
Sbjct: 3061 tgaaccactgaattcaggggatgggggtgggggcccggttctcgaggtgtgtgccagcta 3120

Query: 3121 cacgtgtgttctgtatgggtccagctgcgtttccatcactcgctaataaatcaacagaaa 3180
             ||||||||||||||||||||||||||||||||||||||||||||||||||||||||||||
Sbjct: 3121 cacgtgtgttctgtatgggtccagctgcgtttccatcactcgctaataaatcaacagaaa 3180

Query: 3181 cac 3183
             |||
Sbjct: 3181 cac 3183
```

Figure 4A-5

```
Query: 2221  cagacttgaatcttctcggcccccaaaaatgaaggacctcatttcttatagcctctcctg  2280
             ||||||||||||||||||||||||||||||||||||||||||||||||||||||||||||
Sbjct: 2221  cagacttgaatcttctcggcccccaaaaatgaaggacctcatttcttatagcctctcctg  2280

Query: 2281  tgattcaacacaacccatggagatgtccccttctcactctgaaatcatccatttggggac  2340
             ||||||||||||||||||||||||||||||||||||||||||||||||||||||||||||
Sbjct: 2281  tgattcaacacaacccatggagatgtccccttctcactctgaaatcatccatttggggac  2340

Query: 2341  aaatccacattggggtctagaaacatccacgtatctcatcagccatcttgtcctgtgcat  2400
             ||||||||||||||||||||||||||||||||||||||||||||||||||||||||||||
Sbjct: 2341  aaatccacattggggtctagaaacatccacgtatctcatcagccatcttgtcctgtgcat  2400

Query: 2401  cctaacagaggaaggatccatgattctgctttggtccaattgcttcctctctgcagagga  2460
             ||||||||||||||||||||||||||||||||||||||||||||||||||||||||||||
Sbjct: 2401  cctaacagaggaaggatccatgattctgctttggtccaattgcttcctctctgcagagga  2460

Query: 2461  acaaccccaaaaccagaccactccacgcaggacaggcaggagagattcttcctaaagcct  2520
             ||||||||||||||||||||||||||||||||||||||||||||||||||||||||||||
Sbjct: 2461  acaaccccaaaaccagaccactccacgcaggacaggcaggagagattcttcctaaagcct  2520

Query: 2521  cccccataaaagggagctgtggatccacttagatcagggcggaaccatctttcacccgg   2580
             ||||||||||||||||||||||||||||||||||||||||||||||||||||||||||||
Sbjct: 2521  cccccataaaagggagctgtggatccacttagatcagggcggaaccatctttcacccgg   2580

Query: 2581  ccaagctcctgcccagatgttgaccctcacccagcgtgagctttcacatagtaggagctt  2640
             ||||||||||||||||||||||||||||||||||||||||||||||||||||||||||||
Sbjct: 2581  ccaagctcctgcccagatgttgaccctcacccagcgtgagctttcacatagtaggagctt  2640

Query: 2641  ctagatgcatgtggaagcaatgagagttgtcccttagccttataaactccccatgatctg  2700
             ||||||||||||||||||||||||||||||||||||||||||||||||||||||||||||
Sbjct: 2641  ctagatgcatgtggaagcaatgagagttgtcccttagccttataaactccccatgatctg  2700

Query: 2701  acatgcagaaatccagccttgtccagaatcctcctggaattgcttggaggacgaaagtat  2760
             ||||||||||||||||||||||||||||||||||||||||||||||||||||||||||||
Sbjct: 2701  acatgcagaaatccagccttgtccagaatcctcctggaattgcttggaggacgaaagtat  2760

Query: 2761  gctgggggatgggtgggtactagggagactgggtacaagggtgaaaagtagttcccataa  2820
             ||||||||||||||||||||||||||||||||||||||||||||||||||||||||||||
Sbjct: 2761  gctgggggatgggtgggtactagggagactgggtacaagggtgaaaagtagttcccataa  2820

Query: 2821  tacacatggttgactatggtgatccaccttgtgatggttaatattaggtgtctggagaag  2880
             ||||||||||||||||||||||||||||||||||||||||||||||||||||||||||||
Sbjct: 2821  tacacatggttgactatggtgatccaccttgtgatggttaatattaggtgtctggagaag  2880

Query: 2881  gttgcttcattggccctgggacttctctctgcaggaggagagaacgctgcctctcctctg  2940
             ||||||||||||||||||||||||||||||||||||||||||||||||||||||||||||
Sbjct: 2881  gttgcttcattggccctgggacttctctctgcaggaggagagaacgctgcctctcctctg  2940

Query: 2941  gattggtctcaggctctctgttggcctttggtcagcgtttccacatcctgctctgctgca 3000
             ||||||||||||||||||||||||||||||||||||||||||||||||||||||||||||
Sbjct: 2941  gattggtctcaggctctctgttggcctttggtcagcgtttccacatcctgctctgctgca 3000
```

Figure 4A-4

Figure 4B. Amino acid sequence alignment of 184P1E2 v.1 with human peptidylarginine deiminase type III. The amino acid variation at position 480 is underlined.

```
Score = 1396 bits (3613), Expect = 0.0
Identities = 663/664 (99%), Positives = 663/664 (99%)

Query: 1    MSLQRIVRVSLEHPTSAVCVAGVETLVDIYGSVPEGTEMFEVYGTPGVDIYISPNMERGR  60
            MSLQRIVRVSLEHPTSAVCVAGVETLVDIYGSVPEGTEMFEVYGTPGVDIYISPNMERGR
Sbjct: 1    MSLQRIVRVSLEHPTSAVCVAGVETLVDIYGSVPEGTEMFEVYGTPGVDIYISPNMERGR  60

Query: 61   ERADTRRWRFDATLEIIVVMNSPSNDLNDSHVQISYHSSHEPLPLAYAVLYLTCVDISLD  120
            ERADTRRWRFDATLEIIVVMNSPSNDLNDSHVQISYHSSHEPLPLAYAVLYLTCVDISLD
Sbjct: 61   ERADTRRWRFDATLEIIVVMNSPSNDLNDSHVQISYHSSHEPLPLAYAVLYLTCVDISLD  120

Query: 121  CDLNCEGRQDRNFVDKRQWVWGPSGYGGILLVNCDRDDPSCDVQDNCDQHVHCLQDLEDM  180
            CDLNCEGRQDRNFVDKRQWVWGPSGYGGILLVNCDRDDPSCDVQDNCDQHVHCLQDLEDM
Sbjct: 121  CDLNCEGRQDRNFVDKRQWVWGPSGYGGILLVNCDRDDPSCDVQDNCDQHVHCLQDLEDM  180

Query: 181  SVMVLRTQGPAALFDDHKLVLHTSSYDAKRAQVFHICGPEDVCEAYRHVLGQDKVSYEVP  240
            SVMVLRTQGPAALFDDHKLVLHTSSYDAKRAQVFHICGPEDVCEAYRHVLGQDKVSYEVP
Sbjct: 181  SVMVLRTQGPAALFDDHKLVLHTSSYDAKRAQVFHICGPEDVCEAYRHVLGQDKVSYEVP  240

Query: 241  RLHGDEERFFVEGLSFPDAGFTGLISFHVTLLDDSNEDFSASPIFTDTVVFRVAPWIMTP  300
            RLHGDEERFFVEGLSFPDAGFTGLISFHVTLLDDSNEDFSASPIFTDTVVFRVAPWIMTP
Sbjct: 241  RLHGDEERFFVEGLSFPDAGFTGLISFHVTLLDDSNEDFSASPIFTDTVVFRVAPWIMTP  300

Query: 301  STLPPLEVYVCRVRNNTCFVDAVAELARKAGCKLTICPQAENRNDRWIQDEMELGYVQAP  360
            STLPPLEVYVCRVRNNTCFVDAVAELARKAGCKLTICPQAENRNDRWIQDEMELGYVQAP
Sbjct: 301  STLPPLEVYVCRVRNNTCFVDAVAELARKAGCKLTICPQAENRNDRWIQDEMELGYVQAP  360

Query: 361  HKTLPVVFDSPRNGELQDFPYKRILGPDFGYVTREPRDRSVSGLDSFGNLEVSPPVVANG  420
            HKTLPVVFDSPRNGELQDFPYKRILGPDFGYVTREPRDRSVSGLDSFGNLEVSPPVVANG
Sbjct: 361  HKTLPVVFDSPRNGELQDFPYKRILGPDFGYVTREPRDRSVSGLDSFGNLEVSPPVVANG  420

Query: 421  KEYPLGRILIGGNLPGSSGRRVTQVVRDFLHAQKVQPPVELFVDWLAVGHVDEFLSFVPA  480
            KEYPLGRILIGGNLPGSSGRRVTQVVRDFLHAQKVQPPVELFVDWLAVGHVDEFLSFVP
Sbjct: 421  KEYPLGRILIGGNLPGSSGRRVTQVVRDFLHAQKVQPPVELFVDWLAVGHVDEFLSFVPV  480

Query: 481  PDGKGFRMLLASPGACFKLFQEKQKCGHGRALLFQGVVDDEQVKTISINQVLSNKDLINY  540
            PDGKGFRMLLASPGACFKLFQEKQKCGHGRALLFQGVVDDEQVKTISINQVLSNKDLINY
Sbjct: 481  PDGKGFRMLLASPGACFKLFQEKQKCGHGRALLFQGVVDDEQVKTISINQVLSNKDLINY  540

Query: 541  NKFVQSCIDWNREVLKRELGLAECDIIDIPQLFKTERKKATAFFPDLVNMLVLGKHLGIP  600
            NKFVQSCIDWNREVLKRELGLAECDIIDIPQLFKTERKKATAFFPDLVNMLVLGKHLGIP
Sbjct: 541  NKFVQSCIDWNREVLKRELGLAECDIIDIPQLFKTERKKATAFFPDLVNMLVLGKHLGIP  600

Query: 601  KPFGPIINGCCCLEEKVRSLLEPLGLHCTFIDDFTPYHMLHGEVHCGTNVCRKPFSFKWW  660
            KPFGPIINGCCCLEEKVRSLLEPLGLHCTFIDDFTPYHMLHGEVHCGTNVCRKPFSFKWW
Sbjct: 601  KPFGPIINGCCCLEEKVRSLLEPLGLHCTFIDDFTPYHMLHGEVHCGTNVCRKPFSFKWW  660

Query: 661  NMVP  664
            NMVP
Sbjct: 661  NMVP  664
```

Figure 4C. Amino acid sequence alignment of 184P1E2 v.1 with mouse peptidylarginine deiminase type III.

```
 Score = 1237 bits (3200), Expect = 0.0
 Identities = 582/664 (87%), Positives = 624/664 (93%)

Query: 1    MSLQRIVRVSLEHPTSAVCVAGVETLVDIYGSVPEGTEMFEVYGTPGVDIYISPNMERGR 60
            MSLQRIVRVSLEHPTSAVCVAGVET+VDIYGSVPEGT+MFEVYGTPGVDIY+SP+MER R
Sbjct: 1    MSLQRIVRVSLEHPTSAVCVAGVETIVDIYGSVPEGTDMFEVYGTPGVDIYLSPSMERNR 60

Query: 61   ERADTRRWRFDATLEIIVVMNSPSNDLNDSHVQISYHSSHEPLPLAYAVLYLTCVDISLD 120
            ERADTRRW F+  LEIIVVMNSPSNDLNDSHVQI+YHSS E LPLAYAVLYLTCVDI+LD
Sbjct: 61   ERADTRRWCFNKGLEIIVVMNSPSNDLNDSHVQIAYHSSREHLPLAYAVLYLTCVDITLD 120

Query: 121  CDLNCEGRQDRNFVDKRQWVWGPSGYGGILLVNCDRDDPSCDVQDNCDQHVHCLQDLEDM 180
            CD+NC  RQDR+FVDKRQWVWGP GYG ILLVNCDRD+    QDNCDQ+V CLQDLEDM
Sbjct: 121  CDMNCADRQDRSFVDKRQWVWGPDGYGAILLVNCDRDNVDSNAQDNCDQYVRCLQDLEDM 180

Query: 181  SVMVLRTQGPAALFDDHKLVLHTSSYDAKRAQVFHICGPEDVCEAYRHVLGQDKVSYEVP 240
            SVMVLRTQGP ALF+DH+L+LHTSS DA+RA+VFH+CGPED CEAY+ VLG D++SYEVP
Sbjct: 181  SVMVLRTQGPEALFEDHRLILHTSSCDAERARVFHVCGPEDSCEAYKCVLGPDRMSYEVP 240

Query: 241  RLHGDEERFFVEGLSFPDAGFTGLISFHVTLLDDSNEDFSASPIFTDTVVFRVAPWIMTP 300
            RL G EERFFVEGLSFPDAGF GLISFHVTLLDDSNEDFS +PIFTDT VFRVAPWIMTP
Sbjct: 241  RLKGYEERFFVEGLSFPDAGFPGLISFHVTLLDDSNEDFSETPIFTDTAVFRVAPWIMTP 300

Query: 301  STLPPLEVYVCRVRNNTCFVDAVAELARKAGCKLTICPQAENRNDRWIQDEMELGYVQAP 360
            STLPPLEVYVCRVRNNTCFV+AV ELARKAGCKLTICPQAENRNDRWIQDEMELGYVQAP
Sbjct: 301  STLPPLEVYVCRVRNNTCFVEAVEELARKAGCKLTICPQAENRNDRWIQDEMELGYVQAP 360

Query: 361  HKTLPVVFDSPRNGELQDFPYKRILGPDFGYVTREPRDRSVSGLDSFGNLEVSPPVVANG 420
            HKTLPVVFDSPRNGELQ FPYKRILG DFGYVTREP+D SVSGLDSFGNLEVSPPVVANG
Sbjct: 361  HKTLPVVFDSPRNGELQGFPYKRILGLDFGYVTREPKDSSVSGLDSFGNLEVSPPVVANG 420

Query: 421  KEYPLGRILIGGNLPGSSGRRVTQVVRDFLHAQKVQPPVELFVDWLAVGHVDEFLSFVPA 480
            KEYPLGRILIGGNLPGS GRRVTQVVR+FLHAQKVQP VELFVDWLAVGHVDEFLSFVPA
Sbjct: 421  KEYPLGRILIGGNLPGSRGRRVTQVVRNFLHAQKVQPLVELFVDWLAVGHVDEFLSFVPA 480

Query: 481  PDGKGFRMLLASPGACFKLFQEKQKCGHGRALLFQGVVDDEQVKTISINQVLSNKDLINY 540
            PDGKGFR+LLASPGACF+LFQEKQK GHGR+LLF+GV+ D +V+T+SINQ+L+N+ LIN+
Sbjct: 481  PDGKGFRLLLASPGACFRLFQEKQKWGHGRSLLFEGVIGDRRVQTVSINQILNNQSLINF 540

Query: 541  NKFVQSCIDWNREVLKRELGLAECDIIDIPQLFKTERKKATAFFPDLVNMLVLGKHLGIP 600
            NKF QSCIDWNREVLKRELGLAE DIIDIPQLFKTE++KA AFFPDLVNMLVLGKHLGIP
Sbjct: 541  NKFAQSCIDWNREVLKRELGLAEGDIIDIPQLFKTEKRKAVAFFPDLVNMLVLGKHLGIP 600

Query: 601  KPFGPIINGCCCLEEKVRSLLEPLGLHCTFIDDFTPYHMLHGEVHCGTNVCRKPFSFKWW 660
            KPFGPIING CCLEEKVRSLLEPLGLHCTFIDDFTPYHMLHGEVHCGTNV R+PF+FKWW
Sbjct: 601  KPFGPIINGRCCLEEKVRSLLEPLGLHCTFIDDFTPYHMLHGEVHCGTNVRREPFAFKWW 660

Query: 661  NMVP 664
            +MVP
Sbjct: 661  HMVP 664
```

Figure 4D. Amino acid sequence alignment of 184P1E2 with Rat deiminase type III.

```
Score = 1233 bits (3189), Expect = 0.0
Identities = 580/664 (87%), Positives = 622/664 (93%)

Query: 1    MSLQRIVRVSLEHPTSAVCVAGVETLVDIYGSVPEGTEMFEVYGTPGVDIYISPNMERGR 60
            MSLQR VRVSLEHPTSAVCVAGVET+VDIYGSVPEGT+MFEVYGTPGVDIY+SP+MER R
Sbjct: 1    MSLQRTVRVSLEHPTSAVCVAGVETIVDIYGSVPEGTDMFEVYGTPGVDIYVSPSMERNR 60

Query: 61   ERADTRRWRFDATLEIIVVMNSPSNDLNDSHVQISYHSSHEPLPLAYAVLYLTCVDISLD 120
            ERADTRRW F+ LEIIVVMNSPSNDLNDSHVQI+YHSSHE LPLAYAVLYLTCVDI+LD
Sbjct: 61   ERADTRRWCFNKGLEIIVVMNSPSNDLNDSHVQIAYHSSHEHLPLAYAVLYLTCVDITLD 120

Query: 121  CDLNCEGRQDRNFVDKRQWVWGPSGYGGILLVNCDRDDPSCDVQDNCDQHVHCLQDLEDM 180
            CD+NC  RQDR+FVDKRQW+WGP GYG ILLVNCDRD+ S D QDNCDQ V CLQDLEDM
Sbjct: 121  CDMNCADRQDRSFVDKRQWMWGPDGYGAILLVNCDRDEVSSDAQDNCDQCVRCLQDLEDM 180

Query: 181  SVMVLRTQGPAALFDDHKLVLHTSSYDAKRAQVFHICGPEDVCEAYRHVLGQDKVSYEVP 240
            SVMVLRTQGP +LFDDH+L+LHTSS DA+RA+VFH+CGPED CEAYR VLG D++SYEVP
Sbjct: 181  SVMVLRTQGPESLFDDHRLILHTSSCDAERARVFHVCGPEDSCEAYRCVLGPDRMSYEVP 240

Query: 241  RLHGDEERFFVEGLSFPDAGFTGLISFHVTLLDDSNEDFSASPIFTDTVVFRVAPWIMTP 300
            RL G EERF+VEGLSFPDAGF G++SFH+TLLDDSNED+S +PIFTDTVVFRVAPWIMTP
Sbjct: 241  RLKGYEERFYVEGLSFPDAGFPGILSFHITLLDDSNEDYSETPIFTDTVVFRVAPWIMTP 300

Query: 301  STLPPLEVYVCRVRNNTCFVDAVAELARKAGCKLTICPQAENRNDRWIQDEMELGYVQAP 360
            STLPPLEVYVC+VRNNTCFV+AV ELARKAGCKLTICPQAENRNDRWIQDEMELGY QAP
Sbjct: 301  STLPPLEVYVCQVRNNTCFVEAVEELARKAGCKLTICPQAENRNDRWIQDEMELGYTQAP 360

Query: 361  HKTLPVVFDSPRNGELQDFPYKRILGPDFGYVTREPRDRSVSGLDSFGNLEVSPPVVANG 420
            HKTLPVVFDSPRNGELQ FPYKRILG DFGYVTREP D SVSGLDSFGNLEVSPPVVANG
Sbjct: 361  HKTLPVVFDSPRNGELQGFPYKRILGLDFGYVTREPPDSSVSGLDSFGNLEVSPPVVANG 420

Query: 421  KEYPLGRILIGGNLPGSSGRRVTQVVRDFLHAQKVQPPVELFVDWLAVGHVDEFLSFVPA 480
            KEYPLGRILIGGNLPGS GRRVTQVVRDFLHAQKVQP VELFVDWLAVGHVDEFLSFVPA
Sbjct: 421  KEYPLGRILIGGNLPGSRGRRVTQVVRDFLHAQKVQPLVELFVDWLAVGHVDEFLSFVPA 480

Query: 481  PDGKGFRMLLASPGACFKLFQEKQKCGHGRALLFQGVVDDEQVKTISINQVLSNKDLINY 540
            PDGKGFR+LLASPGACF+LFQEKQK GHGR+LLF+GV+ D +V+TISINQVLSN+ LIN+
Sbjct: 481  PDGKGFRLLLASPGACFRLFQEKQKWGHGRSLLFEGVIGDRRVQTISINQVLSNQSLINF 540

Query: 541  NKFVQSCIDWNREVLKRELGLAECDIIDIPQLFKTERKKATAFFPDLVNMLVLGKHLGIP 600
            NKF QSCIDWNREVLKRELGL E DIIDIPQLFK+E++KA AFFPDLVNMLVLGKHLGIP
Sbjct: 541  NKFAQSCIDWNREVLKRELGLESDIIDIPQLFKSEKRKAVAFFPDLVNMLVLGKHLGIP 600

Query: 601  KPFGPIINGCCCLEEKVRSLLEPLGLHCTFIDDFTPYHMLHGEVHCGTNVCRKPFSFKWW 660
            KPFGPIING  CCLEEKVRSLLEPLGLHCTFIDDFTPYHMLHGEVHCGTNV R+PF+FKWW
Sbjct: 601  KPFGPIINGRCCLEEKVRSLLEPLGLHCTFIDDFTPYHMLHGEVHCGTNVRREPFAFKWW 660

Query: 661  NMVP 664
            +MVP
Sbjct: 661  HMVP 664
```

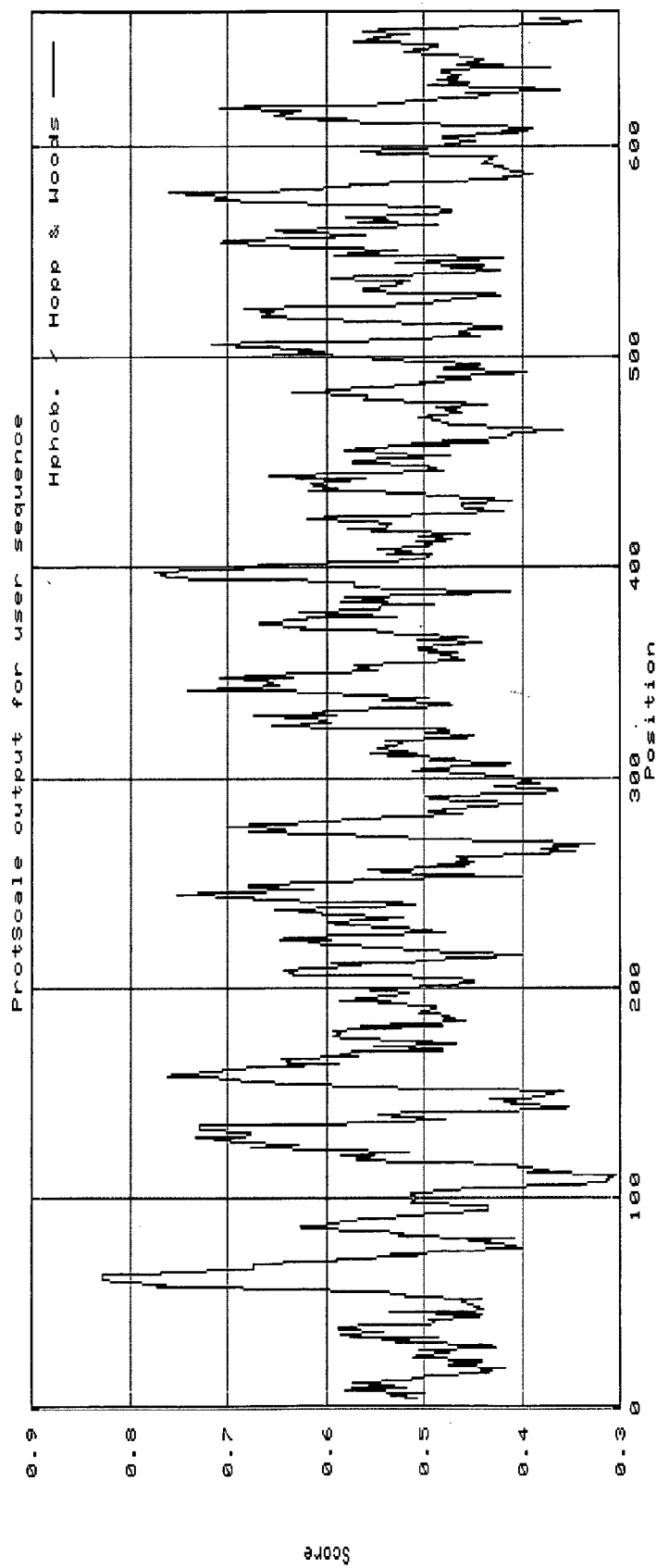
Figure 5 184P1E2 variant 1 Hydrophilicity profile
(Hopp T.P., Woods K.R., 1981. Proc. Natl. Acad. Sci. U.S.A. 78:3824-3828)

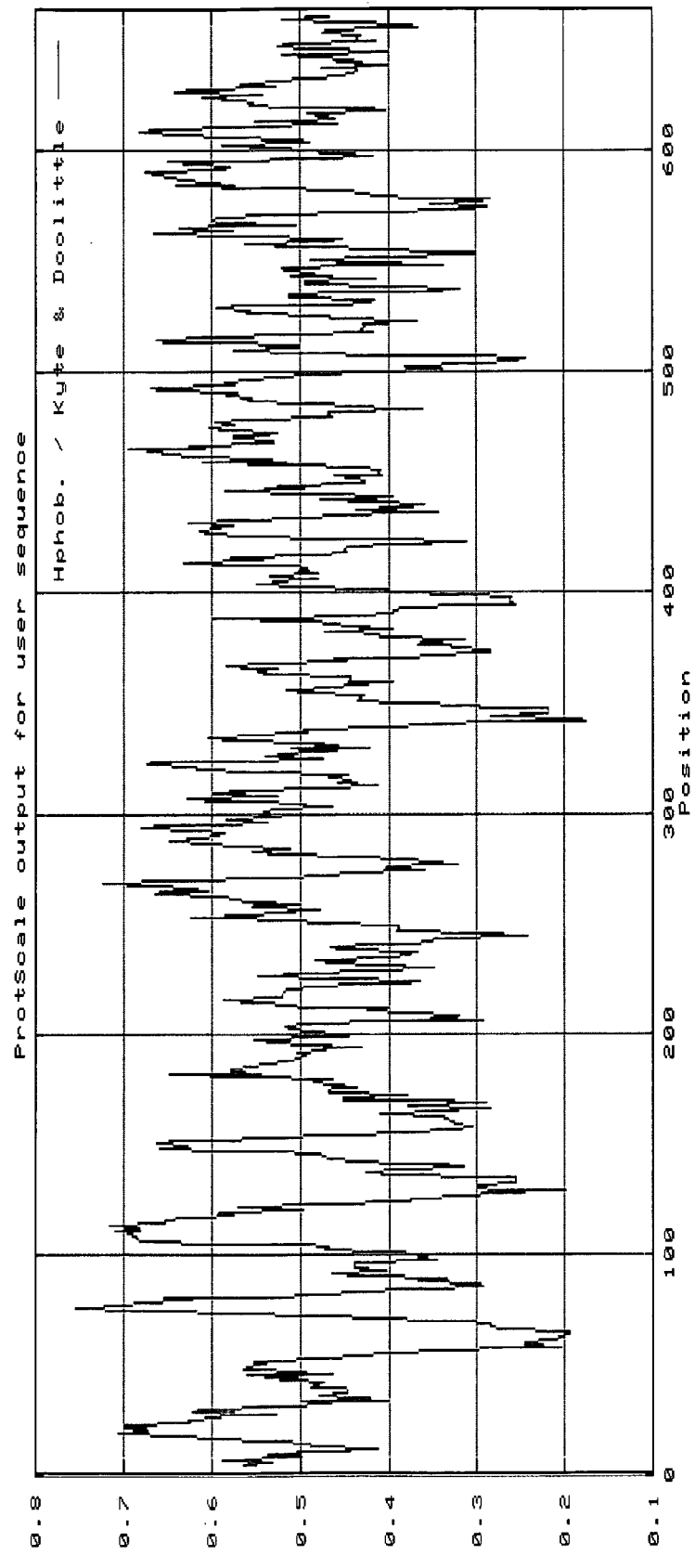
Figure 6 184P1E2 variant 1 Hydropathicity Profile
(Kyte J., Doolittle R.F., 1982. J. Mol. Biol. 157:105-132)

Figure 7  184P1E2 variant 1 % Accessible Residues Profile
(Janin J., 1979. Nature 277:491-492)
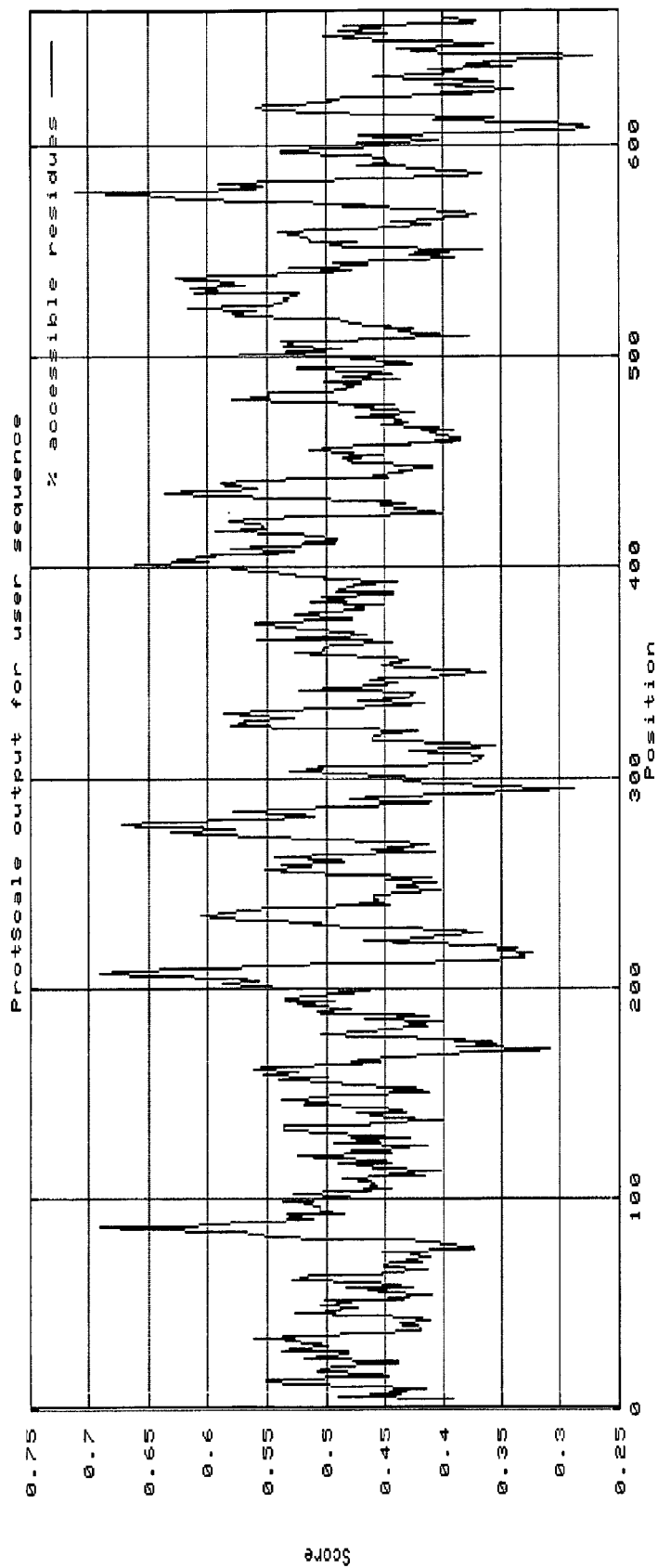

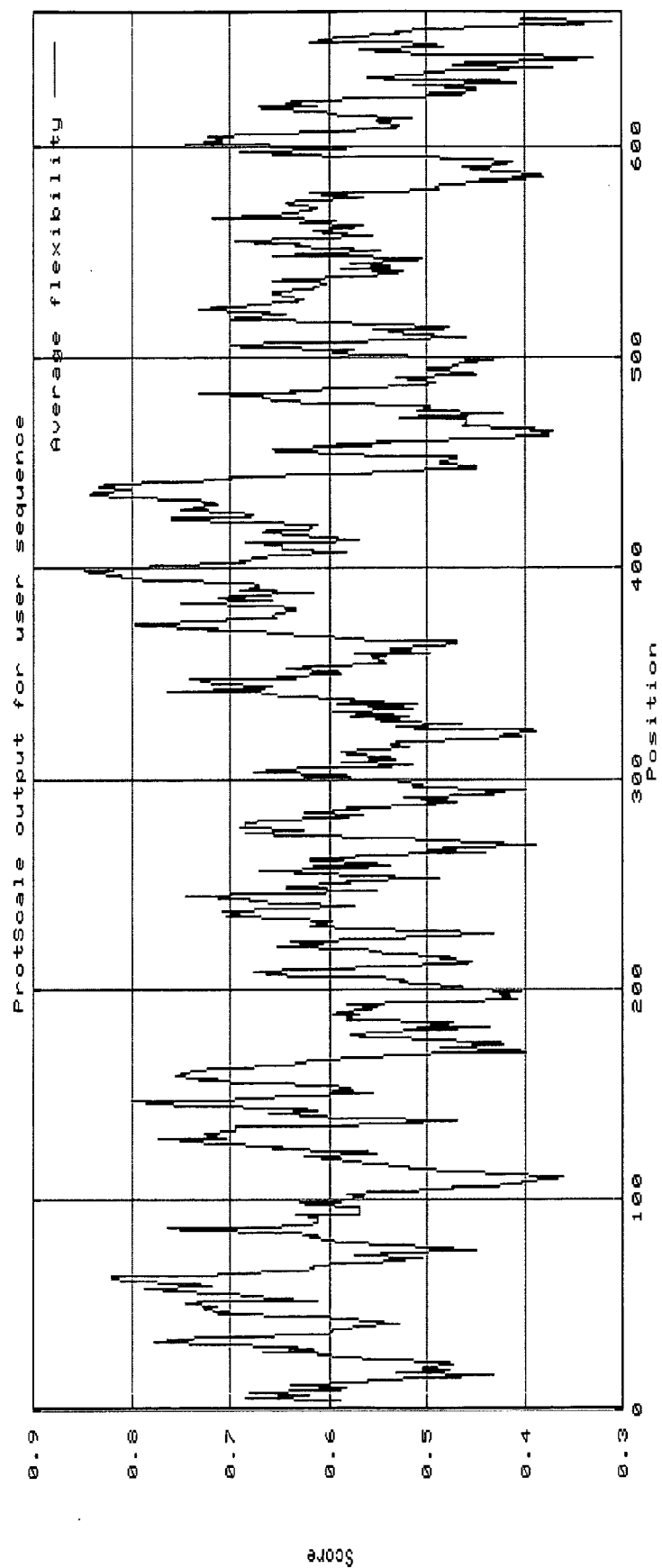
Figure 8  184P1E2 variant 1 Average Flexibility Profile
(Bhaskaran R., Ponnuswamy P.K., 1988.
Int. J. Pept. Protein Res. 32:242-255)

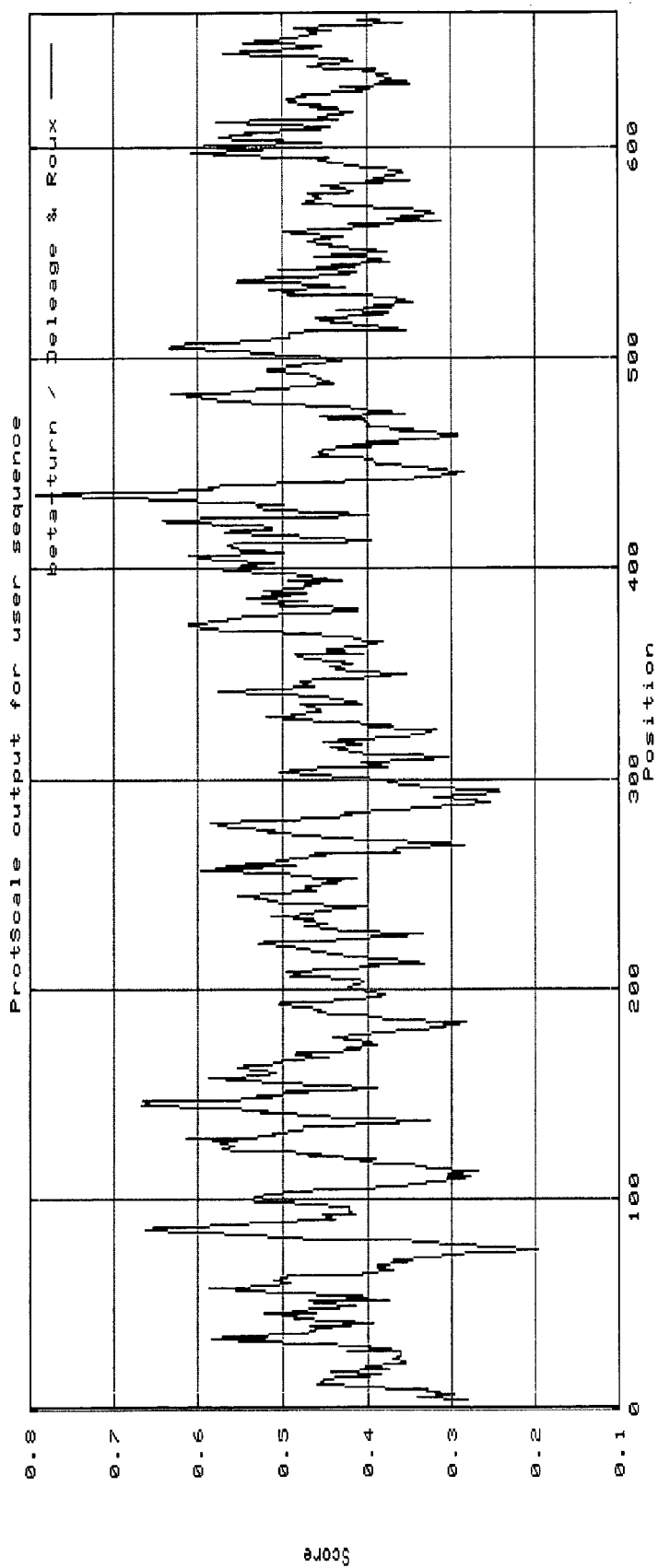
Figure 9 184P1E2 variant 1 Beta-turn Profile
(Deleage, G., Roux B. 1987. Protein Engineering 1:289-294)

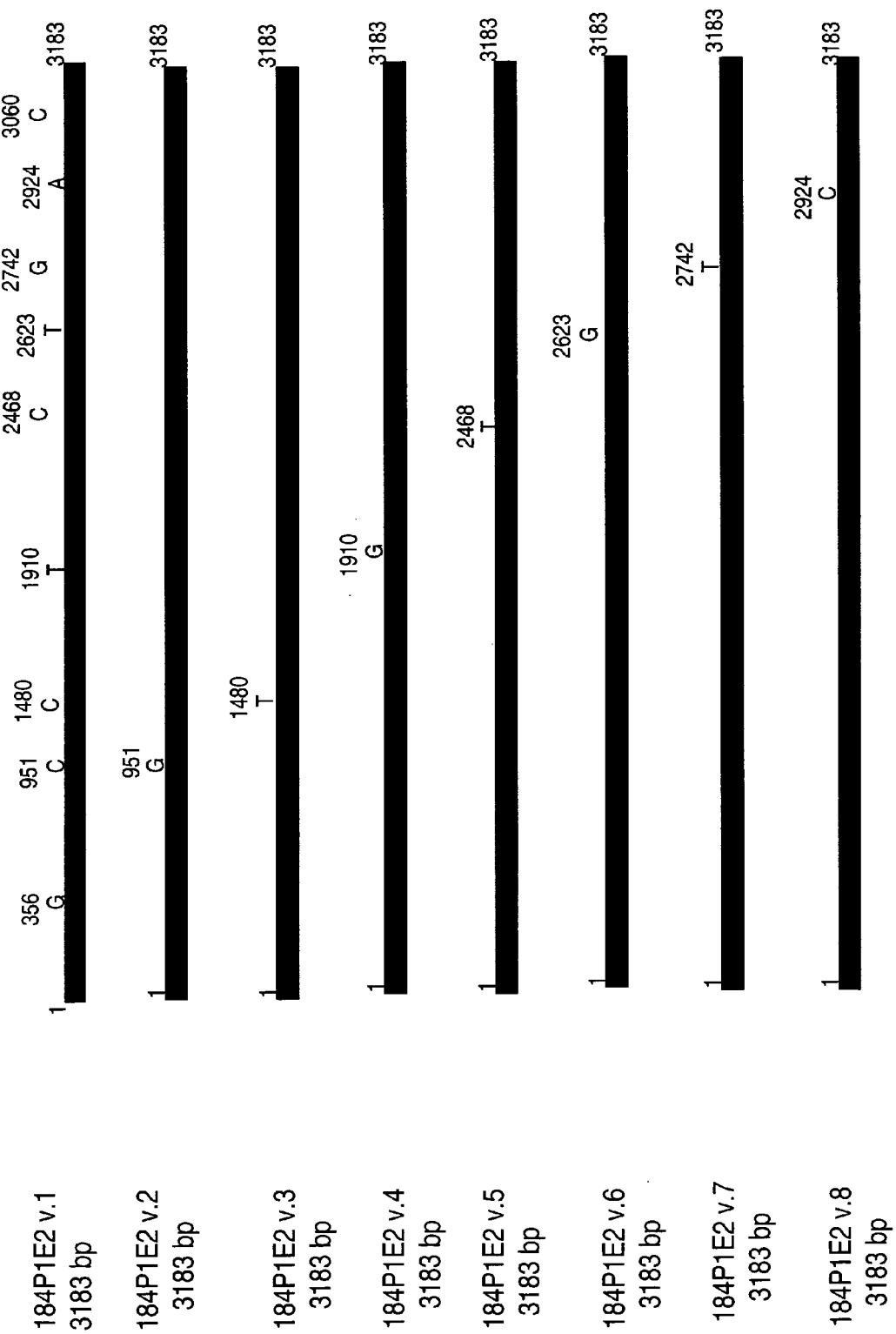
Figure 10 Schematic display of nucleotide variants of 184P1E2

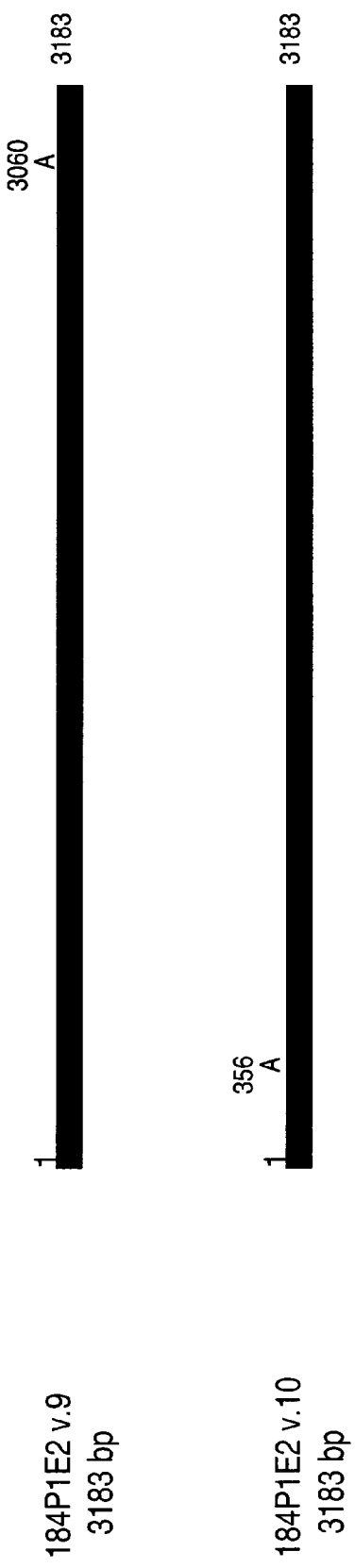

Figure 11 Schematic display of protein variants of 184P1E2
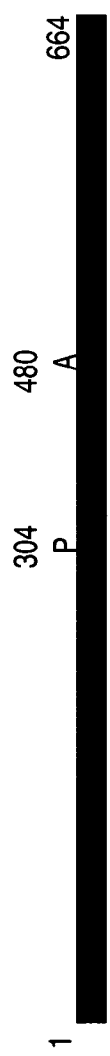
184P1E2 v.1
664 aa
184P1E2 v.2
664 aa
184P1E2 v.3
664 aa

Figure 12. Exon compositions of 184P1E2 v.1

| Exon Number | Start | End |
|---|---|---|
| Exon 1 | 1 | 133 |
| Exon 2 | 134 | 314 |
| Exon 3 | 315 | 387 |
| Exon 4 | 388 | 449 |
| Exon 5 | 450 | 567 |
| Exon 6 | 568 | 693 |
| Exon 7 | 694 | 872 |
| Exon 8 | 873 | 975 |
| Exon 9 | 976 | 1088 |
| Exon 10 | 1089 | 1196 |
| Exon 11 | 1197 | 1348 |
| Exon 12 | 1349 | 1493 |
| Exon 13 | 1494 | 1596 |
| Exon 14 | 1597 | 1676 |
| Exon 15 | 1677 | 1802 |
| Exon 16 | 1803 | 3183 |

Figure 13 Secondary structure of 184P1E2

```
         10        20        30        40        50        60        70
         |         |         |         |         |         |         |
MSLQRIVRVSLEHPTSAVCVAGVETLVDIYGSVPEGTEMFEVYGTPGVDIYISPNMERGRERADTRRWRF
cchheeeeeecccceeeeeccheeeeeeccccceeeeeeccccceeeecccccccccccchhheec DATLEIIVVMNSPSNDLNDSHVQISYHSSHEPLPLAYAVLYLTCVDISLDCDLNCEGRQDRNFVDKRQWV
ccceeeeeecccccccccceeeeeeccccccchhhheeeeeeeecccccccccccccccccceee WGPSGYGGILLVNCDRDDPSCDVQDNCDQHVHCLQDLEDMSVMVLRTQGPAALFDDHKLVLHTSSYDAKR
eccccceeeeecccccccccccccchhhhhhhhhhhhheeeecccceeeeehccceeeeecccccchh AQVFHICGPEDVCEAYRHVLGQDKVSYEVPRLHGDEERFFVEGLSFFPDAGFTGLISFHVTLLDDSNEDFS
heeeeecccchhhhheecccceeeecccccccccchheeeeeeeccccccchhhhheehhcccccccc ASPIFTDTVVFRVAPWIMTPSTLPPLEVVYCRVRNNTCFVDAVAELARKAGCKLTICPQAENRNDRWIQD
cccceeeeeeccccceeecccccccceeeeeeeeecccccchhhhhhhhhhhhcceeeecccccchhhhh EMELGYVQAPHKTLPVVFDSPRNGELQDFPYKRILGPDFGYVTREPRDRSVSGLDSFGNLEVSPPVVANG
hhhcceecccccccceeeeccccccccccchhhhhhhhhhhhccccceeeeecccccccccccccccc KEYPLGRILIGGNLPGSSGRRVTQVVRDFLHAQKVQPPVELFVDWLAVGHVDEFLSFVPAPDGKGFRMLL
ccceeeeecccccccccchhhhhhhhhhhhccccchhhhhhhhhcchhhhhhhhhheecccccceeee ASPGACFKLFQEKQKCGHGRALLFQGVVDDEQVKTISINQVLSNKDLINYNKFVQSCIDWNREVLKRELG
eccchhhhhhhhhhcccccceeeecccccchheeeecccccccceeeccceehhhhhhhhhhhhhc LAECDIIDIPQLFKTERKKATAFFPDLVNMLVLGKHLGIPKPFGPIINGCCLEEKVRSLLEPLGLHCTF
cchhhhhhhhhhhhhhhhhhhhhhhhccccccccccchccchhhhhhhhhhccccehh IDDFTPYHMLHGEVHCGTNVCRKPFSFKWNMVP
hccccccceccccccccccccceeeccccc
```

Alpha helix    : 25.30%
Extended strand : 22.59%
Random coil    : 52.11%

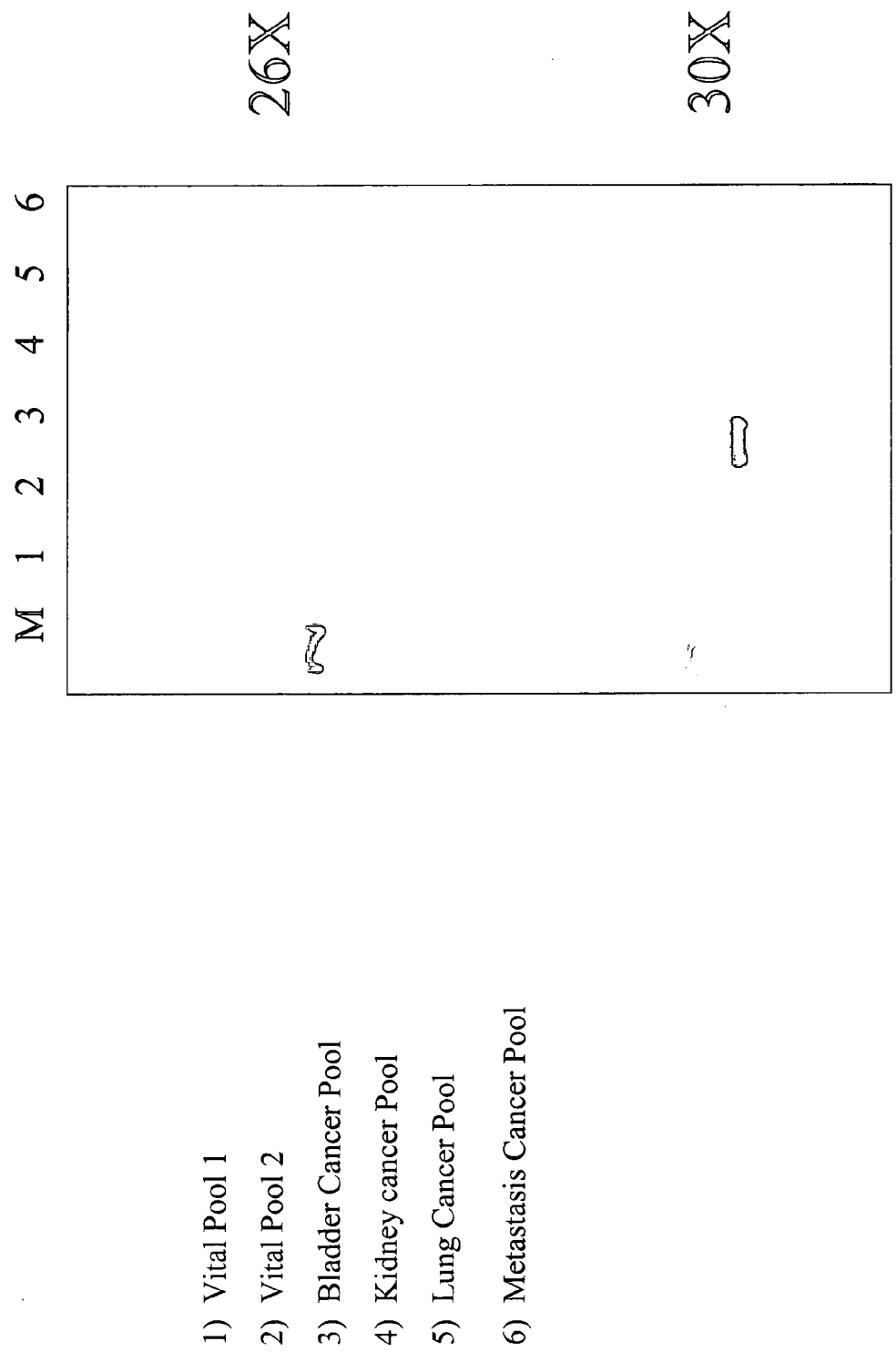
Figure 14 Expression of 184P1E2 by RT-PCR
1) Vital Pool 1
2) Vital Pool 2
3) Bladder Cancer Pool
4) Kidney cancer Pool
5) Lung Cancer Pool
6) Metastasis Cancer Pool

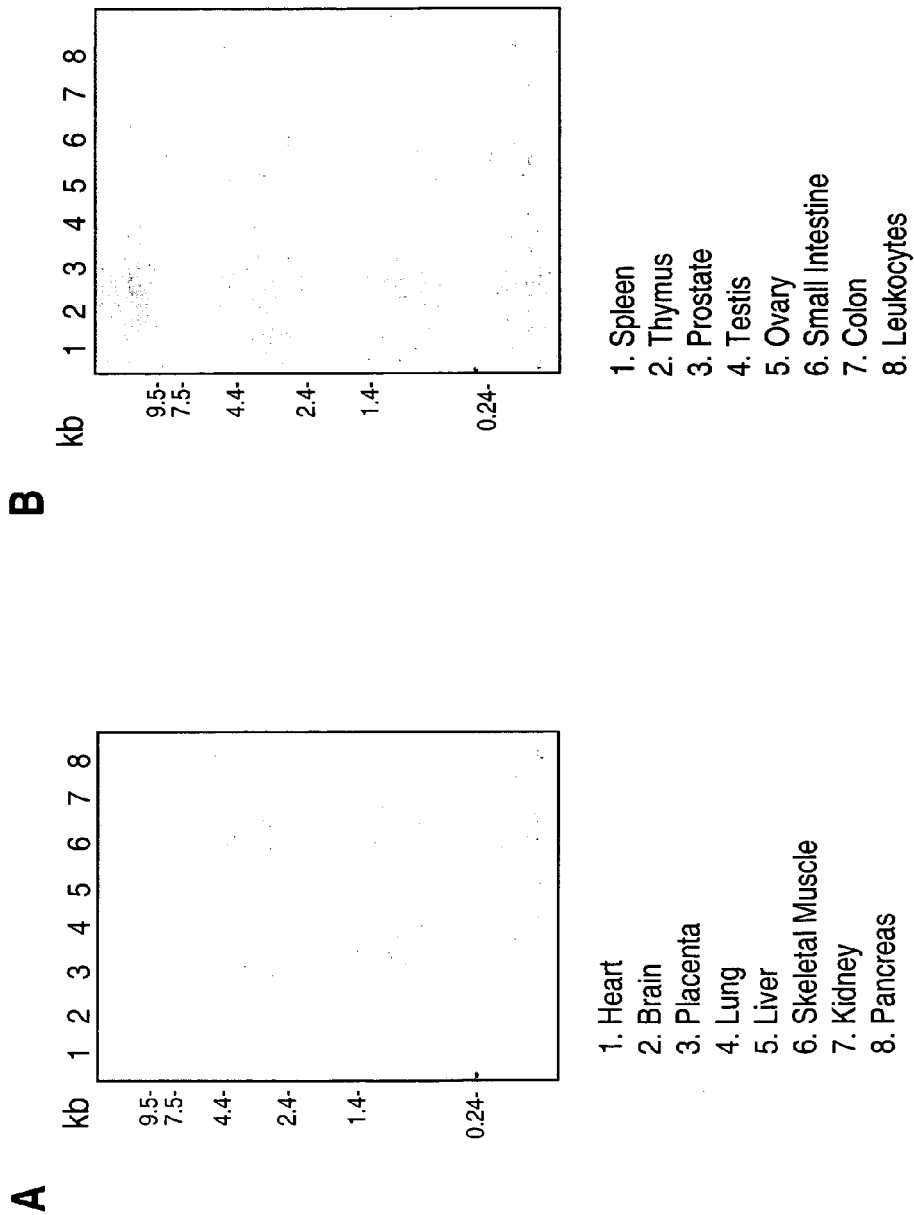
Figure 15 Expression of 184P1E2 in Normal Tissues by Northern Blot

Figure 16 Expression of 184P1E2 in Patient Cancer Specimens and Normal Tissues
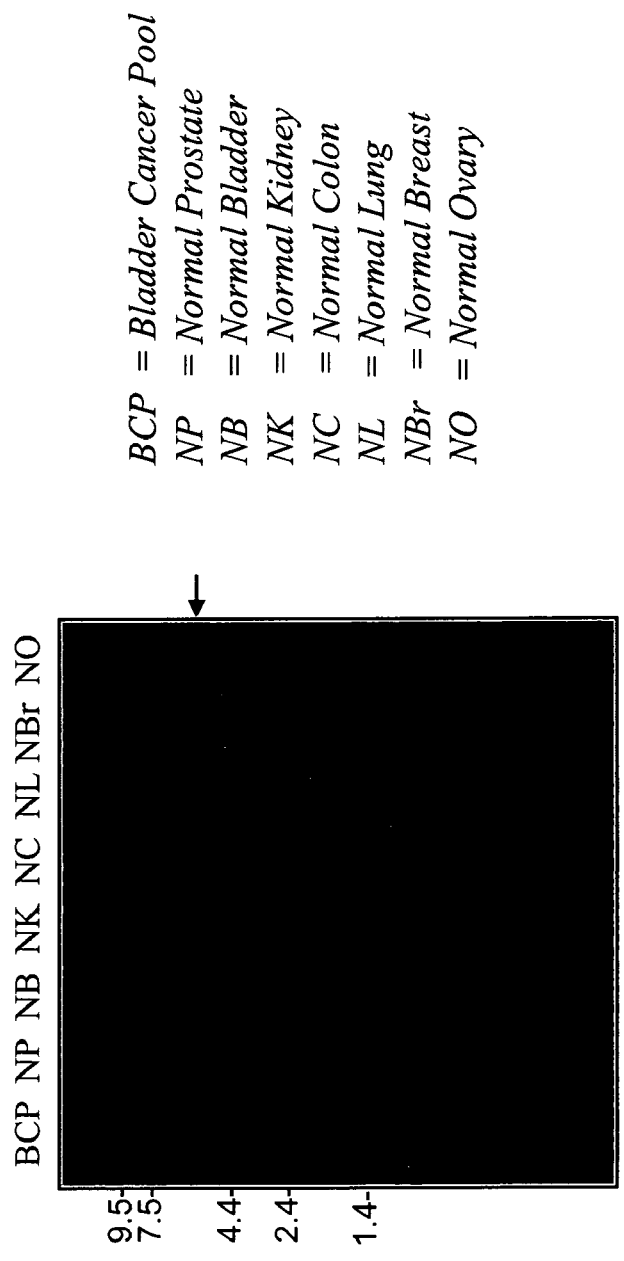

Figure 17 Expression of 184P1E2 in Bladder Cancer Patient Specimens by Northern Blot
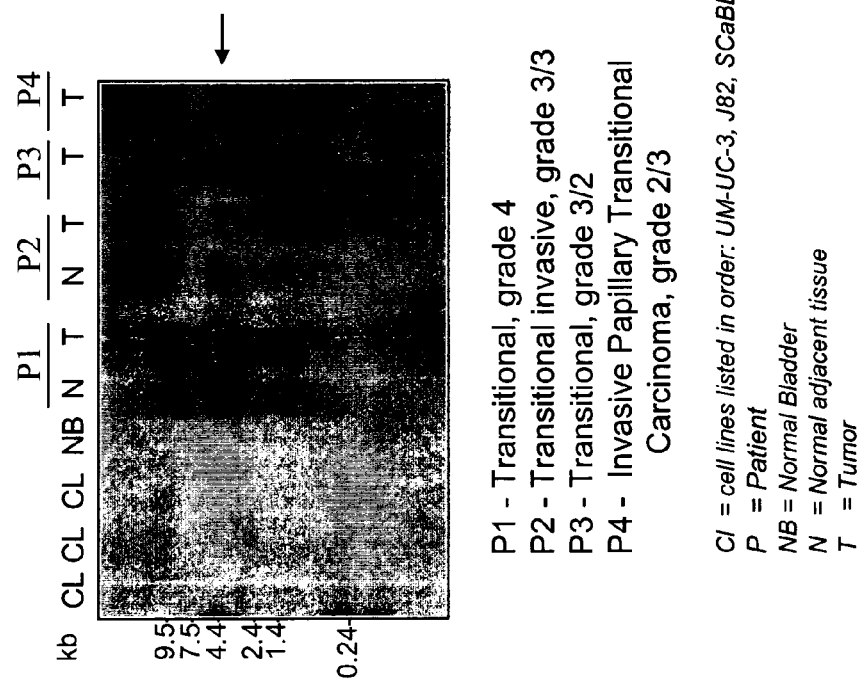

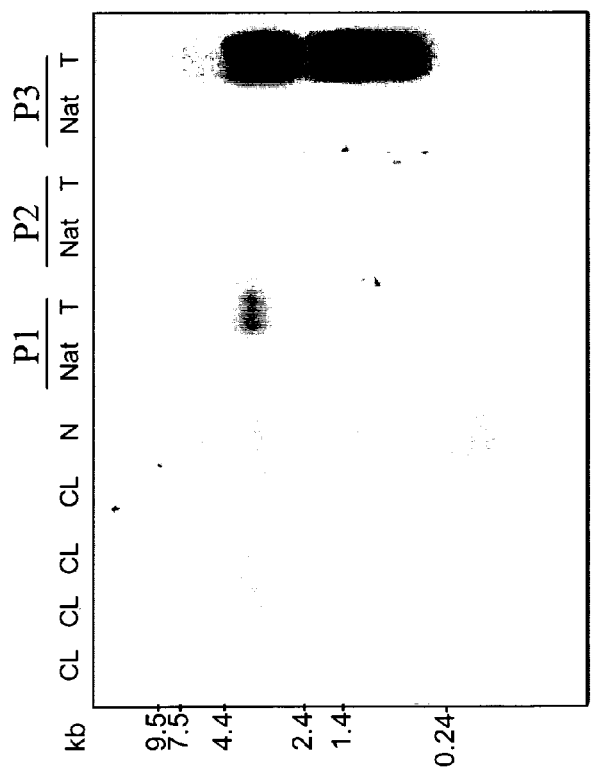
Figure 18 Expression of 184P1E2 in Lung Cancer Patient Specimens by Northern Blot
CL = Cell lines (from left to right): CALU-1, A427, NCI-H82, NCI-146
N = Normal lung
Nat = Normal adjacent tissue
T = Tumor
P1 - Squamous cell lung carcinoma, stage IB
P2 - Squamous cell lung carcinoma, stage IIB
P3 - Squamous cell lung carcinoma, stage IB

US 7,135,549 B1

NUCLEIC ACID AND CORRESPONDING PROTEIN ENTITLED 184P1E2 USEFUL IN TREATMENT AND DETECTION OF CANCER

CROSS-REFERENCE TO RELATED APPLICATIONS

This application claims priority from U.S. Ser. No. 60/282,739 filed Apr. 10, 2001, and U.S. Ser. No. 60/286,630, filed Apr. 25, 2001. The contents of these applications are hereby incorporated by reference herein in their entirety.

SUBMISSION ON COMPACT DISC

The contents of the following submission on compact discs are incorporated herein by reference in its entirety: A compact disc copy of the Sequence Listing (COPY 1) (file name: 5115820067.txt, date recorded: Aug. 14, 2002, size: 2,463 KB); a duplicate compact disc copy of Sequence Listing (COPY 2) (file name: 5115820067.txt, date recorded: Aug. 14, 2002, size: 2,463 KB); a computer readable form copy of the Sequence Listing (CRF COPY) (file name: 5115820067.txt, date recorded: Aug. 14, 2002, size: 2,463).

STATEMENT OF RIGHTS TO INVENTIONS MADE UNDER FEDERALLY SPONSORED RESEARCH

Not applicable.

FIELD OF THE INVENTION

The invention described herein relates to a gene and its encoded protein, termed 184P1E2, expressed in certain cancers, and to diagnostic and therapeutic methods and compositions useful in the management of cancers that express 184P1E2.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445–51), STEAP (Hubert, et al., Proc. Natl. Acad. Sci. USA. 1999 Dec. 7; 96(25): 14523–8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and 8 per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992–1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992–1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992–1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992–1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 184P1E2, that has now been found to be over-expressed in the cancer(s) listed in Table I. Northern blot expression analysis of 184P1E2 gene expression in normal tissues shows a restricted expression pattern in adult tissues. The nucleotide (FIG. 2) and amino acid (FIG. 2, and FIG. 3) sequences of 184P1E2 are provided. The tissue-related profile of 184P1E2 in normal adult tissues, combined with the over-expression observed in the tissues listed in Table I, shows that 184P1E2 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 184P1E2 genes, mRNAs, and/or coding sequences, preferably in isolated form, including polynucleotides encoding 184P1E2-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 184P1E2-related protein, as well as the peptides/proteins themselves; DNA, RNA, DNA/RNA hybrids, and related molecules, polynucleotides or oligonucleotides complementary or having at least a 90% homology to the 184P1E2 genes or mRNA sequences or parts thereof, and polynucleotides or oligonucleotides that hybridize to the 184P1E2 genes, mRNAs, or to 184P1E2-encoding polynucleotides. Also provided are means for isolating cDNAs and the genes encoding 184P1E2. Recombinant DNA molecules containing 184P1E2 polynucleotides, cells transformed or transduced with such molecules, and host-vector systems for the expression of 184P1E2 gene products are also provided. The invention further provides antibodies that bind to 184P1E2 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 184P1E2 polynucleotides and proteins in various biological samples, as well as methods for identifying cells that express 184P1E2. A typical embodiment of this invention provides methods for monitoring 184P1E2 gene products in a tissue or hematology sample having or suspected of having some form of growth dysregulation such as cancer.

The invention further provides various immunogenic or therapeutic compositions and strategies for treating cancers that express 184P1E2 such as cancers of tissues listed in Table I, including therapies aimed at inhibiting the transcription, translation, processing or function of 184P1E2 as well as cancer vaccines. In one aspect, the invention provides compositions, and methods comprising them, for treating a cancer that expresses 184P1E2 in a human subject wherein the composition comprises a carrier suitable for human use and a human unit dose of one or more than one agent that inhibits the production or function of 184P1E2. Preferably, the carrier is a uniquely human carrier. In another aspect of the invention, the agent is a moiety that is immunoreactive with 184P1E2 protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 184P1E2 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 184P1E2 as described above. The one or more than one nucleic acid molecule may also be, or encodes, a molecule that inhibits production of 184P1E2. Non-limiting examples of such molecules include, but are not limited to, those complementary to a nucleotide sequence essential for production of 184P1E2 (e.g. antisense sequences or molecules that form a triple helix with a nucleotide double helix essential for 184P1E2 production) or a ribozyme effective to lyse 184P1E2 mRNA.

Note that to determine the starting position of any peptide set forth in Tables V–XVIII and XXII to LI (collectively HLA Peptide Tables) respective to its parental protein, e.g., variant 1, variant 2, etc., reference is made to three factors: the particular variant, the length of the peptide in an HLA Peptide Table, and the Search Peptides in Table LII. Generally, a unique Search Peptide is used to obtain HLA peptides of a particular for a particular variant. The position of each Search Peptide relative to its respective parent molecule is listed in Table LII. Accordingly, if a Search Peptide begins at position "X", one must add the value "X−1" to each position in Tables V–XVIII and XXII to LI to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables V–XVIII and XXII to LI collectively, or an oligonucleotide that encodes the HLA peptide. Another embodiment of the invention comprises an HLA peptide that occurs at least once in Tables V–XVIII and at least once in tables XXII to LI, or an oligonucleotide that encodes the HLA peptide.

Another embodiment of the invention is antibody epitopes which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

BRIEF DESCRIPTION OF THE FIGURES

FIG. 1. The 184P1E2 SSH sequence (SEQ ID NO.: 1) of 132 nucleotides.

FIG. 2. The cDNA (SEQ ID. NO.: 2) and amino acid sequence (SEQ ID. NO.: 3) of 184P1E2 variant 1 (also called "184P1E2 v.1" or "184P1E2 variant 1") is shown in FIG. 2A. The start methionine is underlined. The open reading frame extends from nucleic acid 42–2036 including the stop codon. The cDNA (SEQ ID. NO.: 4) and amino acid sequence (SEQ ID. NO.: 5) of 184P1E2 variant 2 (also called "184P1E2 v.2") is shown in FIG. 2B. The codon for the start methionine is underlined. The open reading frame extends from nucleic acid 42–2036 including the stop codon. The cDNA (SEQ. ID. NO.: 6) and amino acid sequence (SEQ. ID. NO.: 7) of 184P1E2 variant 3 (also called "184P1E2 v.3") is shown in FIG. 2C. The codon for the start methionine is underlined. The open reading frame extends from nucleic acid 42–2036 including the stop codon. The cDNA (SEQ. ID. NO.: 8) and amino acid sequence (SEQ. ID. NO.: 9) of 184P1E2 variant 4 (also called "184P1E2 v.4") is shown in FIG. 2D. The codon for the start methionine is underlined. The open reading frame extends from nucleic acid 42–2036 including the stop codon. The cDNA (SEQ. ID. NO.: 10) and amino acid sequence (SEQ. ID. NO.: 11) of 184P1E2 variant 5 (also called "184P1E2 v.5") is shown in FIG. 2E. The codon for the start methionine is underlined. The open reading frame extends from nucleic acid 42–2036 including the stop codon. The cDNA (SEQ ID. NO.: 12) and amino acid sequence (SEQ. ID. NO.: 13) of 184P1E2 variant 6 (also called "184P1E2 v.6") is shown in FIG. 2F. The codon for the start methionine is underlined. The open reading frame extends from nucleic acid 42–2036 including the stop codon. The cDNA (SEQ. ID. NO.: 14) and amino acid sequence (SEQ ID. NO.: 15) of 184P1E2 variant 7 (also called "184P1E2 v.7") is shown in FIG. 2G. The codon for the start methionine is underlined. The open reading frame extends from nucleic acid 42–2036 including the stop codon. The cDNA (SEQ. ID. NO.: 16) and amino acid sequence (SEQ. ID. NO.: 17) of 184P1E2 variant 8 (also called "184P1E2 v.8") is shown in FIG. 2H. The codon for the start methionine is underlined. The open reading frame extends from nucleic acid 42–2036 including the stop codon. The cDNA (SEQ. ID. NO.: 18) and amino acid sequence (SEQ ID. NO.: 19) of 184P1E2 variant 9 (also called "184P1E2 v.9") is shown in FIG. 2I. The codon for the start methionine is underlined. The open reading frame extends from nucleic acid 42–2036 including the stop codon. The cDNA (SEQ. ID. NO.: 20) and amino acid sequence (SEQ. ID. NO.: 21) of 184P1E2 variant 10 (also called "184P1E2 v.10") is shown in FIG. 2J. The codon for the start methionine is underlined. The open reading frame extends from nucleic acid 42–2036 including the stop codon. As used herein, a reference to 184P1E2 includes all variants thereof, including those shown in FIGS. 10 and 12.

FIG. 3. Amino acid sequence of 184P1E2 v.1 (SEQ. ID. NO.: 3) is shown in FIG. 3A; it has 664 amino acids. The amino acid sequence of 184P1E2 v.2 (SEQ. ID. NO.: 4) is shown in FIG. 3B; it has 664 amino acids. The amino acid sequence of 184P1E2 v.3 (SEQ. ID. NO.: 5) is shown in FIG. 3C; it has 664 amino acids. As used herein, a reference to 184P1E2 includes all variants thereof, including those shown in FIG. 11.

FIG. 4. The nucleic acid sequence alignment of 184P1E2 v.1 (SEQ. ID NO.: 2) with human peptidylarginine deiminase type III (SEQ. ID NO.: 22) is shown in FIG. 4A. The nucleic acid differences are underlined. The amino acid sequence alignment of 184P1E2 v.1 (SEQ. ID. NO.: 3) with human peptidylarginine deiminase type III (SEQ. ID. NO.: 23) is shown in FIG. 4B. The amino acid variation at position 480 is underlined. The amino acid sequence alignment of 184P1E2 v.1 (SEQ. ID. NO.: 3) with mouse peptidylarginine deiminase type III (SEQ. ID. NO.: 24) is shown in FIG. 4C. The amino acid sequence alignment of 184P1E2 v.1 (SEQ. ID NO.: 3) with Rat deiminase type III (SEQ. ID NO.: 25) is shown in FIG. 4D.

FIG. 5. Hydrophilicity amino acid profile of 184P1E2 variant 1, determined by computer algorithm sequence analysis using the method of Hopp and Woods (Hopp T. P., Woods K. R., 1981. Proc. Natl. Acad. Sci. U.S.A. 78:3824–3828) accessed on the Protscale website through the ExPasy molecular biology server.

FIG. 6. Hydropathicity amino acid profile of 184P1E2 variant 1, determined by computer algorithm sequence analysis using the method of Kyte and Doolittle (Kyte J., Doolittle R. F., 1982. J. Mol. Biol. 157:105–132) accessed on the ProtScale website through the ExPasy molecular biology server.

FIG. 7. Percent accessible residues amino acid profile of 184P1E2 variant 1, determined by computer algorithm sequence analysis using the method of Janin (Janin J., 1979 Nature 277:491–492) accessed on the ProtScale website through the ExPasy molecular biology server.

FIG. 8. Average flexibility amino acid profile of 184P1E2 variant 1, determined by computer algorithm sequence analysis using the method of Bhaskaran and Ponnuswamy (Bhaskaran R., and Ponnuswamy P. K., 1988. Int. J. Pept. Protein Res. 32:242–255) accessed on the ProtScale website through the ExPasy molecular biology server.

FIG. 9. Beta-turn amino acid profile of 184P1E2 variant 1, determined by computer algorithm sequence analysis using the method of Deleage and Roux (Deleage, G., Roux B. 1987 Protein Engineering 1:289–294) accessed on the ProtScale website through the ExPasy molecular biology server.

FIG. 10. Schematic display of nucleotide variants of 184P1E2. Variants 184P1E2 v.2 through v.10 are variants with single nucleotide variation. The black boxes show the same sequence as 184P1E2 v.1. The numbers correspond to those of 184P1E2 v. 1. Single Nucleotide Polymorphisms (also called "SNPs") are indicated above the boxes.

FIG. 11. Schematic display of protein variants of 184P1E2. Nucleotide variants 184P1E2 v.1, v.2 and v.3 in FIG. 10 code for protein variants 184P1E2 v.1, v.2 and v.3, respectively. Variants 184P1E2 v.4 through v.10 code the same protein as variant 184P1E2 v.1. Protein variants 184P1E2 v.2 and v.3 are variants with single amino acid variations. The black boxes show the same sequence as 184P1E2 v.1. The numbers correspond to those of 184P1E2 v.1. Single amino acid differences are indicated above the box.

FIG. 12. The exon composition of the original transcript, designated as 184P1E2 v.1.

FIG. 13. Secondary structure prediction for 184P1E2 (SEQ ID NO.: 3). The secondary structure of 184P1E2 variant 1 was predicted using the HNN—Hierarchical Neural Network method (Guermeur, 1997), accessed from the ExPasy molecular biology server. This method predicts the presence and location of alpha helices, extended strands, and random coils from the primary protein sequence. The percent of the protein in a given secondary structure is also listed.

FIG. 14. Expression of 184P1E2 by RT-PCR. First strand cDNA was prepared from vital pool 1 (liver, lung and kidney), vital pool 2 (pancreas, colon and stomach), bladder cancer pool, kidney cancer pool, lung cancer pool, and cancer metastasis pool. Normalization was performed by PCR using primers to actin and GAPDH. Semi-quantitative PCR, using primers to 184P1E2, was performed at 26 and 30 cycles of amplification. Results show strong expression of 184P1E2 in bladder cancer pool. Expression of 184P1E2 is also detected in kidney cancer pool, lung cancer pool and cancer metastasis pool, but not in vital pool 1 and vital pool 2.

FIG. 15. Expression of 184P1E2 in normal tissues. Two multiple tissue northern blots (Clontech) both with 2 ug of mRNA/lane were probed with the 184P1E2 sequence. Size standards in kilobases (kb) are indicated on the side. Results show absence of expression of 184P1E2 in all 16 normal tissues tested.

FIG. 16. Expression of 184P1E2 in Patient Cancer Specimens and Normal Tissues. RNA was extracted from a pool of three bladder cancers (BCP), as well as from normal prostate (NP), normal bladder (NB), normal kidney (NK), normal colon (NC), normal lung (NL), normal breast (NBr) and normal ovary (NO). Northern blot with 10 μg of total RNA/lane was probed with 184P1E2 sequence. Size standards in kilobases (kb) are indicated on the side. An approximately 4.5 kb 184P1E2 transcript was detected in the bladder cancer pool but not in the normal tissues tested.

FIG. 17. Expression of 184P1E2 in bladder cancer patient tissues. RNA was extracted from normal bladder (NB), bladder cancer cell lines (CL; UM-UC-3, J82, SCaBER), bladder cancer patient tumors (T) and their normal adjacent tissues (N). Northern blots with 10 ug of total RNA were probed with the 184P1E2 sequence. Size standards in kilobases are indicated on the side. Results show strong expression of 184P1E2 in patient bladder cancer tissues.

FIG. 18. Expression of 184P1E2 in lung cancer patient tissues. RNA was extracted from lung cancer cell lines (CL) (CALU-1, A427, NCI-H82, NCI-146), normal lung (N), lung cancer patient tumors (T) and their normal adjacent tissues (Nat). Northern blots with 10 ug of total RNA were probed with the 184P1E2 sequence. Size standards in kilobases are on the side. Results show strong expression of 184P1E2 in patient lung cancer tissues, but not in normal lung. A lower molecular weight transcript was also detected in the two cell lines CALU-1 and NCI-146.

DETAILED DESCRIPTION OF THE INVENTION

Outline of Sections

| | | |
|---|---|---|
| I.) | Definitions | |
| II.) | 184P1E2 Polynucleotides | |
| | II.A.) | Uses of 184P1E2 Polynucleotides |
| | | II.A.1.) Monitoring of Genetic Abnormalities |
| | | II.A.2.) Antisense Embodiments |
| | | II.A.3.) Primers and Primer Pairs |
| | | II.A.4.) Isolation of 184P1E2-Encoding Nucleic Acid Molecules |
| | | II.A.5.) Recombinant Nucleic Acid Molecules and Host-Vector Systems |
| III.) | 184P1E2-related Proteins | |
| | III.A.) | Motif-bearing Protein Embodiments |
| | III.B.) | Expression of 184P1E2-related Proteins |
| | III.C.) | Modifications of 184P1E2-related Proteins |
| | III.D.) | Uses of 184P1E2-related Proteins |
| IV.) | 184P1E2 Antibodies | |
| V.) | 184P1E2 Cellular Immune Responses | |
| VI.) | 184P1E2 Transgenic Animals | |
| VII.) | Methods for the Detection of 184P1E2 | |
| VIII.) | Methods for Monitoring the Status of 184P1E2-related Genes and Their Products | |
| IX.) | Identification of Molecules That Interact With 184P1E2 | |
| X.) | Therapeutic Methods and Compositions | |
| | X.A.) | Anti-Cancer Vaccines |
| | X.B.) | 184P1E2 as a Target for Antibody-Based Therapy |
| | X.C.) | 184P1E2 as a Target for Cellular Immune Responses |
| | | X.C.1.) Minigene Vaccines |
| | | X.C.2.) Combinations of CTL Peptides with Helper Peptides |
| | | X.C.3.) Combinations of CTL Peptides with T Cell Priming Agents |
| | | X.C.4.) Vaccine Compositions Comprising DC Pulsed with CTL and/or HTL Peptides |
| | X.D.) | Adoptive Immunotherapy |
| | X.E.) | Administration of Vaccines for Therapeutic or Prophylactic Purposes |
| XI.) | Diagnostic and Prognostic Embodiments of 184P1E2. | |
| XII.) | Inhibition of 184P1E2 Protein Function | |
| | XII.A.) | Inhibition of 184P1E2 With Intracellular Antibodies |
| | XII.B.) | Inhibition of 184P1E2 with Recombinant Proteins |
| | XII.C.) | Inhibition of 184P1E2 Transcription or Translation |
| | XII.D.) | General Considerations for Therapeutic Strategies |
| XIII.) | KITS | |

I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1–C2 disease under the Whitmore-Jewett system, and stage T3–T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 184P1E2 (either by removing the underlying glycosylation site or by deleting the glycosylation by chemical and/or enzymatic means), and/or adding one or more glycosylation sites that are not present in the native sequence 184P1E2. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 184P1E2-related protein). For example an analog of a 184P1E2 protein can be specifically bound by an antibody or T cell that specifically binds to 184P1E2.

The term "antibody" is used in the broadest sense. Therefore an "antibody" can be naturally occurring or man-made such as monoclonal antibodies produced by conventional hybridoma technology. Anti-184P1E2 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-184P1E2 antibodies and clones thereof (including agonist, antagonist and neutralizing antibodies) and anti-184P1E2 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to maytansinoids, yttrium, bismuth, ricin, ricin A-chain, doxorubicin, daunorubicin, taxol, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alpha-sarcin, gelonin, mitogellin, retstrictocin, phenomycin, enomycin, curicin, crotin, calicheamicin, sapaonaria officinalis inhibitor, and glucocorticoid and other chemotherapeutic agents, as well as radioisotopes such as $At^{211}$, $I^{131}$, $I^{125}$, $Y^{90}$, $Re^{188}$, $Sm^{153}$, $Bi^{212}$, $P^{32}$ and radioactive isotopes of Lu. Antibodies may also be conjugated to an anti-cancer pro-drug activating enzyme capable of converting the pro-drug to its active form.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6× SSC/0.1% SDS/100 µg/ml ssDNA, in which temperatures for hybridization are above 37 degrees C. and temperatures for washing in 0.1× SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 184P1E2 genes or that encode polypeptides other than 184P1E2 gene product or fragments thereof A skilled artisan can readily employ nucleic acid isolation procedures to obtain an isolated 184P1E2 polynucleotide. A protein is said to be "isolated," for example, when physical, mechanical or chemical methods are employed to remove the 184P1E2 proteins from cellular constituents that are normally associated with the protein. A skilled artisan can readily employ standard purification methods to obtain an isolated 184P1E2 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a 184P1E2-related protein, refers to any pattern of amino acids forming part of the primary sequence of a protein, that is associated with a particular function (e.g. protein—protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. In another embodiment, for example, the primary anchor residues of a peptide that will bind an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

A "recombinant" DNA or RNA molecule is a DNA or RNA molecule that has been subjected to molecular manipulation in vitro.

Non-limiting examples of small molecules include compounds that bind or interact with 184P1E2, ligands including hormones, neuropeptides, chemokines, odorants, phospholipids, and functional equivalents thereof that bind and preferably inhibit 184P1E2 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 184P1E2 protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5× SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2× SSC (sodium chloride/sodium citrate) and 50% formamide at 55° C., followed by a high-stringency wash consisting of 0.1× SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5× SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1× SSC at about 37–50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles.

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1–150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g. dendritic cells.

The term "variant" refers to a molecule that exhibits a variation from a described type or norm, such as a protein that has one or more different amino acid residues in the corresponding position(s) of a specifically described protein (e.g. the 184P1E2 protein shown in FIG. 2 or FIG. 3. An analog is an example of a variant protein. Splice isoforms and single nucleotides polymorphisms (SNPs) are further examples of variants.

The "184P1E2-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 184P1E2 proteins or fragments thereof, as well as fusion proteins of a 184P1E2 protein and a heterologous polypeptide are also included. Such 184P1E2 proteins are collectively referred to as the 184P1E2-related proteins, the proteins of the invention, or 184P1E2. The term "184P1E2-related protein" refers to a polypeptide fragment or a 184P1E2 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, or 664 or more amino acids.

II.) 184P1E2 Polynucleotides

One aspect of the invention provides polynucleotides corresponding or complementary to all or part of a 184P1E2 gene, mRNA, and/or coding sequence, preferably in isolated form, including polynucleotides encoding a 184P1E2-related protein and fragments thereof, DNA, RNA, DNA/RNA hybrid, and related molecules, polynucleotides or oligonucleotides complementary to a 184P1E2 gene or mRNA sequence or a part thereof, and polynucleotides or oligonucleotides that hybridize to a 184P1E2 gene, mRNA, or to a 184P1E2 encoding polynucleotide (collectively, "184P1E2 polynucleotides"). In all instances when referred to in this section, T can also be U in FIG. 2.

Embodiments of a 184P1E2 polynucleotide include: a 184P1E2 polynucleotide having the sequence shown in FIG. 2, the nucleotide sequence of 184P1E2 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 184P1E2 nucleotides comprise, without limitation:

(I) a polynucleotide comprising, consisting essentially of, or consisting of a sequence as shown in FIG. 2A (SEQ. ID NO: 2), wherein T can also be U;

(II) a polynucleotide comprising, consisting essentially of, or consisting of the sequence as shown in FIG. 2A (SEQ. ID NO: 2), from nucleotide residue number 42 through nucleotide residue number 2036, including the stop codon, wherein T can also be U;

(III) a polynucleotide comprising, consisting essentially of, or consisting of the sequence as shown in FIG. 2B (SEQ. ID NO: 4), from nucleotide residue number 42 through nucleotide residue number 2036, including the stop codon, wherein T can also be U;

(IV) a polynucleotide comprising, consisting essentially of, or consisting of the sequence as shown in FIG. 2C (SEQ. ID NO: 6), from nucleotide residue number 42 through nucleotide residue number 2036, including the a stop codon, wherein T can also be U;

(V) a polynucleotide comprising, consisting essentially of, or consisting of the sequence as shown in FIG. 2D (SEQ ID NO: 8), from nucleotide residue number 42 through nucleotide residue number 2036, including the stop codon, wherein T can also be U;

(VI) a polynucleotide comprising, consisting essentially of, or consisting of the sequence as shown in FIG. 2E (SEQ. ID NO: 10), from nucleotide residue number 42 through nucleotide residue number 2036, including the stop codon, wherein T can also be U;

(VII) a polynucleotide comprising, consisting essentially of, or consisting of the sequence as shown in FIG. 2F (SEQ. ID NO: 12), from nucleotide residue number 42 through nucleotide residue number 2036, including the stop codon, wherein T can also be U;

(VIII) a polynucleotide comprising, consisting essentially of, or consisting of the sequence as shown in FIG. 2G (SEQ. ID NO: 4), from nucleotide residue number 42 through nucleotide residue number 2036, including the stop codon, wherein T can also be U;

(IX) a polynucleotide comprising, consisting essentially of, or consisting of the sequence as shown in FIG. 2H (SEQ. ID NO: 16), from nucleotide residue number 42 through nucleotide residue number 2036, including the stop codon, wherein T can also be U;

(X) a polynucleotide comprising, consisting essentially of, or consisting of the sequence as shown in FIG. 2I (SEQ. ID NO: 18), from nucleotide residue number 42 through nucleotide residue number 2036, including the stop codon, wherein T can also be U;

(XII) a polynucleotide comprising, consisting essentially of, or consisting of the sequence as shown in FIG. 2J (SEQ ID NO: 20), from nucleotide residue number 42 through nucleotide residue number 2036, including the stop codon, wherein T can also be U;

(XIII) a polynucleotide that encodes a 184P1E2-related protein that is at least 90% homologous to an entire amino acid sequence shown in FIGS. 2A–J (SEQ. ID NO: 3);

(XIV) a polynucleotide that encodes a 184P1E2-related protein that is at least 90% identical to an entire amino acid sequence shown in FIGS. 2A–J (SEQ ID NO: 5);

(XV) a polynucleotide that encodes at least one peptide set forth in Tables V–XVIII and XXII–LI;

(XVI) a polynucleotide that encodes a peptide region of at least 5 amino acids of a peptide of FIG. 3A in any whole number increment up to 664 that includes an amino acid position having a value greater than 0.5 in the Hydrophilicity profile of FIG. 5;

(XVII) a polynucleotide that encodes a peptide region of at least 5 amino acids of a peptide of FIG. 3A in any whole number increment up to 664 that includes an amino acid position having a value less than 0.5 in the Hydropathicity profile of FIG. 6;

(XVIII) a polynucleotide that encodes a peptide region of at least 5 amino acids of a peptide of FIG. 3A in any whole number increment up to 664 that includes an amino acid position having a value greater than 0.5 in the Percent Accessible Residues profile of FIG. 7;

(XIX) a polynucleotide that encodes a peptide region of at least 5 amino acids of a peptide of FIG. 3A in any whole number increment up to 664 that includes an amino acid position having a value greater than 0.5 in the Average Flexibility profile of FIG. 8;

(XX) a polynucleotide that encodes a peptide region of at least 5 amino acids of a peptide of FIG. 3A in any whole number increment up to 664 that includes an amino acid position having a value greater than 0.5 in the Beta-turn profile of FIG. 9;

(XXI) a polynucleotide that is fully complementary to a polynucleotide of any one of (I)—(XX).

(XXII) a peptide that is encoded by any of (I)–(XXI); and (XXI) a polynucleotide of any of (I)–(XXI) or peptide of (XXII) together with a pharmaceutical excipient and/or in a human unit dose form.

As used herein, a range is understood to specifically disclose all whole unit positions thereof.

Typical embodiments of the invention disclosed herein include 184P1E2 polynucleotides that encode specific portions of 184P1E2 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, or 664 or more contiguous amino acids of 184P1E2.

For example, representative embodiments of the invention disclosed herein include: polynucleotides and their encoded peptides themselves encoding about amino acid 1 to about amino acid 10 of the 184P1E2 protein shown in FIG. 2 or FIG. 3, polynucleotides encoding about amino acid 10 to about amino acid 20 of the 184P1E2 protein shown in FIG. 2 or FIG. 3, polynucleotides encoding about amino acid 20 to about amino acid 30 of the 184P1E2 protein shown in FIG. 2 or FIG. 3, polynucleotides encoding about amino acid 30 to about amino acid 40 of the 184P1E2 protein shown in FIG. 2 or FIG. 3, polynucleotides encoding about amino acid 40 to about amino acid 50 of the 184P1E2 protein shown in FIG. 2 or FIG. 3, polynucleotides encoding about amino acid 50 to about amino acid 60 of the 184P1E2 protein shown in FIG. 2 or FIG. 3, polynucleotides encoding about amino acid 60 to about amino acid 70 of the 184P1E2 protein shown in FIG. 2 or FIG. 3, polynucleotides encoding about amino acid 70 to about amino acid 80 of the 184P1E2 protein shown in FIG. 2 or FIG. 3, polynucleotides encoding about amino acid 80 to about amino acid 90 of the 184P1E2 protein shown in FIG. 2 or FIG. 3, polynucleotides encoding about amino acid 90 to about amino acid 100 of the 184P1E2 protein shown in FIG. 2 or FIG. 3, in increments of about 10 amino acids, ending at the carboxyl terminal amino acid set forth in FIG. 2 or FIG. 3. Accordingly polynucleotides encoding portions of the amino acid sequence (of about 10 amino acids), of amino acids 100 through the carboxyl terminal amino acid of the 184P1E2 protein are embodiments of the invention. Wherein it is understood that each particular amino acid position discloses that position plus or minus five amino acid residues.

Polynucleotides encoding relatively long portions of a 184P1E2 protein are also within the scope of the invention. For example, polynucleotides encoding from about amino acid 1 (or 20 or 30 or 40 etc.) to about amino acid 20, (or 30, or 40 or 50 etc.) of the 184P1E2 protein "or variant" shown in FIG. 2 or FIG. 3 can be generated by a variety of techniques well known in the art. These polynucleotide fragments can include any portion of the 184P1E2 sequence as shown in FIG. 2.

Additional illustrative embodiments of the invention disclosed herein include 184P1E2 polynucleotide fragments encoding one or more of the biological motifs contained within a 184P1E2 protein "or variant" sequence, including one or more of the motif-bearing subsequences of a 184P1E2 protein "or variant" set forth in Tables V–XVIII and XXII–LI. In another embodiment, typical polynucleotide fragments of the invention encode one or more of the regions of 184P1E2 protein or variant that exhibit homology to a known molecule. In another embodiment of the invention, typical polynucleotide fragments can encode one or more of the 184P1E2 protein or variant N-glycosylation sites, cAMP and cGMP-dependent protein kinase phosphorylation sites, casein kinase II phosphorylation sites or N-myristoylation site and amidation sites.

II.A.) Uses of 184P1E2 Polynucleotides

II.A.1.) Monitoring of Genetic Abnormalities

The polynucleotides of the preceding paragraphs have a number of different specific uses. The human 184P1E2 gene maps to the chromosomal location set forth in the Example entitled "Chromosomal Mapping of 184P1E2." For example, because the 184P1E2 gene maps to this chromosome, polynucleotides that encode different regions of the 184P1E2 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3–4): 81–83 (1998); Johansson et al., Blood 86(10): 3905–3914 (1995) and Finger et al., P.N.A.S. 85(23): 9158–9162 (1988)). Thus, polynucleotides encoding specific regions of the 184P1E2 proteins provide new tools that can be used to delineate, with greater precision than previously possible, cytogenetic abnormalities in the chromosomal region that encodes 184P1E2 that may contribute to the malignant phenotype. In this context, these polynucleotides satisfy a need in the art for expanding the sensitivity of chromosomal screening in order to identify more subtle and less common chromosomal abnormalities (see e.g. Evans et. al., Am. J. Obstet. Gynecol 171(4): 1055–1057 (1994)).

Furthermore, as 184P1E2 was shown to be highly expressed in bladder and other cancers, 184P1E2 polynucleotides are used in methods assessing the status of 184P1E2 gene products in normal versus cancerous tissues. Typically, polynucleotides that encode specific regions of the 184P1E2 proteins are used to assess the presence of perturbations (such as deletions, insertions, point mutations, or alterations resulting in a loss of an antigen etc.) in specific regions of the 184P1E2 gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369–378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 184P1E2. For example, antisense molecules can be RNAs or other molecules, including peptide nucleic acids (PNAs) or non-nucleic acid molecules such as phosphorothioate derivatives, that specifically bind DNA or RNA in a base pair-dependent manner. A skilled artisan can readily obtain these classes of nucleic acid molecules using the 184P1E2 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 184P1E2. See for example, Jack Cohen, Oligodeoxynucleotides, Antisense Inhibitors of Gene Expression, CRC Press, 1989; and Synthesis 1:1–5 (1988). The 184P1E2 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693–4698 (1990); and Iyer, R. P. et al., J. Am. Chem. Soc. 112:1253–1254 (1990). Additional 184P1E2 antisense oligonucleotides of the present invention include morpholino antisense oligonucleotides known in the art (see, e.g., Partridge et al., 1996, Antisense & Nucleic Acid Drug Development 6: 169–175).

The 184P1E2 antisense oligonucleotides of the present invention typically can be RNA or DNA that is complementary to and stably hybridizes with the first 100 5' codons or last 100 3' codons of a 184P1E2 genomic sequence or the corresponding mRNA. Absolute complementarity is not required, although high degrees of complementarity are preferred. Use of an oligonucleotide complementary to this region allows for the selective hybridization to 184P1E2 mRNA and not to mRNA specifying other regulatory subunits of protein kinase. In one embodiment, 184P1E2 antisense oligonucleotides of the present invention are 15 to 30-mer fragments of the antisense DNA molecule that have a sequence that hybridizes to 184P1E2 mRNA. Optionally, 184P1E2 antisense oligonucleotide is a 30-mer oligonucleotide that is complementary to a region in the first 10 5' codons or last 10 3' codons of 184P1E2. Alternatively, the antisense molecules are modified to employ ribozymes in the inhibition of 184P1E2 expression, see, e.g., L. A. Couture & D. T. Stinchcomb; Trends Genet 12: 510–515 (1996).

II.A.3.) Primers and Primer Pairs

Further specific embodiments of this nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 184P1E2 polynucleotide in a sample and as a means for detecting a cell expressing a 184P1E2 protein.

Examples of such probes include polypeptides comprising all or part of the human 184P1E2 cDNA sequence shown in FIG. 2. Examples of primer pairs capable of specifically amplifying 184P1E2 mRNAs are also described in the Examples. As will be understood by the skilled artisan, a great many different primers and probes can be prepared based on the sequences provided herein and used effectively to amplify and/or detect a 184P1E2 mRNA.

The 184P1E2 polynucleotides of the invention are useful for a variety of purposes, including but not limited to their use as probes and primers for the amplification and/or detection of the 184P1E2 gene(s), mRNA(s), or fragments thereof; as reagents for the diagnosis and/or prognosis of prostate cancer and other cancers; as coding sequences capable of directing the expression of 184P1E2 polypeptides; as tools for modulating or inhibiting the expression of the 184P1E2 gene(s) and/or translation of the 184P1E2 transcript(s); and as therapeutic agents.

The present invention includes the use of any probe as described herein to identify and isolate a 184P1E2 or 184P1E2 related nucleic acid sequence from a naturally occurring source, such as humans or other mammals, as well as the isolated nucleic acid sequence per se, which would comprise all or most of the sequences found in the probe used.

II.A.4.) Isolation of 184P1E2-Encoding Nucleic Acid Molecules

The 184P1E2 cDNA sequences described herein enable the isolation of other polynucleotides encoding 184P1E2 gene product(s), as well as the isolation of polynucleotides encoding 184P1E2 gene product homologs, alternatively spliced isoforms, allelic variants, and mutant forms of a 184P1E2 gene product as well as polynucleotides that encode analogs of 184P1E2-related proteins. Various molecular cloning methods that can be employed to isolate full length cDNAs encoding a 184P1E2 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 184P1E2 gene cDNAs can be identified by probing with a labeled 184P1E2 cDNA or a fragment thereof. For example, in one embodiment, a 184P1E2 cDNA (e.g., FIG. 2) or a portion thereof can be synthesized and used as a probe to retrieve overlapping and full-length cDNAs corresponding to a 184P1E2 gene. A 184P1E2 gene itself can be isolated by screening genomic DNA libraries, bacterial artificial chromosome libraries (BACs), yeast artificial chromosome libraries (YACs), and the like, with 184P1E2 DNA probes or primers.

II.A.5.) Recombinant Nucleic Acid Molecules and Host-Vector Systems

The invention also provides recombinant DNA or RNA molecules containing a 184P1E2 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 184P1E2 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 184P1E2 or a fragment, analog or homolog thereof can be used to generate 184P1E2 proteins or fragments thereof using any number of host-vector systems routinely used and widely known in the art.

A wide range of host-vector systems suitable for the expression of 184P1E2 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 184P1E2 can be expressed in several prostate cancer and non-prostate cell lines, including for example 293, 293T, rat-1, NIH 3T3 and TsuPr1. The host-vector systems of the invention are useful for the production of a 184P1E2 protein or fragment thereof. Such host-vector systems can be employed to study the functional properties of 184P1E2 and 184P1E2 mutations or analogs.

Recombinant human 184P1E2 protein or an analog or homolog or fragment thereof can be produced by mammalian cells transfected with a construct encoding a 184P1E2-related nucleotide. For example, 293T cells can be transfected with an expression plasmid encoding 184P1E2 or fragment, analog or homolog thereof, a 184P1E2-related protein is expressed in the 293T cells, and the recombinant 184P1E2 protein is isolated using standard purification methods (e.g., affinity purification using anti-184P1E2 antibodies). In another embodiment, a 184P1E2 coding sequence is subcloned into the retroviral vector pSRαMSVtkneo and used to infect various mammalian cell lines, such as NIH 3T3, TsuPr1, 293 and rat-1 in order to establish 184P1E2 expressing cell lines. Various other expression systems well known in the art can also be employed. Expression constructs encoding a leader peptide joined in frame to a 184P1E2 coding sequence can be used for the generation of a secreted form of recombinant 184P1E2 protein.

As discussed herein, redundancy in the genetic code permits variation in 184P1E2 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.,* 9:5073–5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662–2666, (1995) and Kozak NAR 15(20): 8125–8148 (1987)).

III) 184P1E2-Related Proteins

Another aspect of the present invention provides 184P1E2-related proteins. Specific embodiments of 184P1E2 proteins comprise a polypeptide having all or part of the amino acid sequence of human 184P1E2 as shown in FIG. 2 or FIG. 3. Alternatively, embodiments of 184P1E2 proteins comprise variant, homolog or analog polypeptides that have alterations in the amino acid sequence of 184P1E2 shown in FIG. 2 or FIG. 3.

In general, naturally occurring allelic variants of human 184P1E2 share a high degree of structural identity and homology (e.g., 90% or more homology). Typically, allelic variants of a 184P1E2 protein contain conservative amino acid substitutions within the 184P1E2 sequences described herein or contain a substitution of an amino acid from a corresponding position in a homologue of 184P1E2. One class of 184P1E2 allelic variants are proteins that share a high degree of homology with at least a small region of a particular 184P1E2 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13–15 "Biochemistry" $2^{nd}$ ED. Lubert Stryer ed (Stanford University); Henikoff et al., PNAS 1992 Vol 89 10915–10919; Lei et al., J Biol Chem 1995 May 19; 270(20):11882–6).

Embodiments of the invention disclosed herein include a wide variety of art-accepted variants or analogs of 184P1E2 proteins such as polypeptides having amino acid insertions, deletions and substitutions. 184P1E2 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA,* 317:415 (1986)) or other known techniques can be performed on the cloned DNA to produce the 184P1E2 variant DNA.

Scanning amino acid analysis can also be employed to identify one or more amino acids along a contiguous sequence that is involved in a specific biological activity such as a protein—protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, The Proteins, (W.H. Freeman & Co., N.Y.); Chothia, J. Mol. Biol., 150:1 (1976)). If alanine substitution does not yield adequate amounts of variant, an isosteric amino acid can be used.

As defined herein, 184P1E2 variants, analogs or homologs, have the distinguishing attribute of having at least one epitope that is "cross reactive" with a 184P1E2 protein having an amino acid sequence of FIG. 3. As used in this sentence, "cross reactive" means that an antibody or T cell that specifically binds to a 184P1E2 variant also specifically binds to a 184P1E2 protein having an amino acid sequence set forth in FIG. 3. A polypeptide ceases to be a variant of a protein shown in FIG. 3, when it no longer contains any epitope capable of being recognized by an antibody or T cell that specifically binds to the starting 184P1E2 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949–6955; Hebbes et al., Mol Immunol (1989) 26(9):865–73; Schwartz et al., J Immunol (1985) 135(4):2598–608.

Other classes of 184P1E2-related protein variants share 70%, 75%, 80%, 85% or 90% or more similarity with an amino acid sequence of FIG. 3, or a fragment thereof. Another specific class of 184P1E2 protein variants or analogs comprise one or more of the 184P1E2 biological motifs described herein or presently known in the art. Thus, encompassed by the present invention are analogs of 184P1E2 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 184P1E2 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 184P1E2 protein shown in FIG. 2 or FIG. 3.

Moreover, representative embodiments of the invention disclosed herein include polypeptides consisting of about amino acid 1 to about amino acid 10 of a 184P1E2 protein shown in FIG. 2 or FIG. 3, polypeptides consisting of about amino acid 10 to about amino acid 20 of a 184P1E2 protein shown in FIG. 2 or FIG. 3, polypeptides consisting of about amino acid 20 to about amino acid 30 of a 184P1E2 protein shown in FIG. 2 or FIG. 3, polypeptides consisting of about amino acid 30 to about amino acid 40 of a 184P1E2 protein shown in FIG. 2 or FIG. 3, polypeptides consisting of about amino acid 40 to about amino acid 50 of a 184P1E2 protein shown in FIG. 2 or FIG. 3, polypeptides consisting of about amino acid 50 to about amino acid 60 of a 184P1E2 protein shown in FIG. 2 or FIG. 3, polypeptides consisting of about amino acid 60 to about amino acid 70 of a 184P1E2 protein shown in FIG. 2 or FIG. 3, polypeptides consisting of about amino acid 70 to about amino acid 80 of a 184P1E2 protein shown in FIG. 2 or FIG. 3, polypeptides consisting of about amino acid 80 to about amino acid 90 of a 184P1E2 protein shown in FIG. 2 or FIG. 3, polypeptides consisting of about amino acid 90 to about amino acid 100 of a 184P1E2 protein shown in FIG. 2 or FIG. 3, etc. throughout the entirety of a 184P1E2 amino acid sequence. Moreover, polypeptides consisting of about amino acid 1 (or 20 or 30 or 40 etc.) to about amino acid 20, (or 130, or 140 or 150 etc.) of a 184P1E2 protein shown in FIG. 2 or FIG. 3 are embodiments of the invention. It is to be appreciated that the starting and stopping positions in this paragraph refer to the specified position as well as that position plus or minus 5 residues.

184P1E2-related proteins are generated using standard peptide synthesis technology or using chemical cleavage methods well known in the art. Alternatively, recombinant methods can be used to generate nucleic acid molecules that encode a 184P1E2-related protein. In one embodiment, nucleic acid molecules provide a means to generate defined fragments of a 184P1E2 protein (or variants, homologs or analogs thereof).

III.A.) Motif-Bearing Protein Embodiments

Additional illustrative embodiments of the invention disclosed herein include 184P1E2 polypeptides comprising the amino acid residues of one or more of the biological motifs contained within a 184P1E2 polypeptide sequence set forth in FIG. 2 or FIG. 3. Various motifs are known in the art, and a protein can be evaluated for the presence of such motifs by a number of publicly available Internet sites (see, e.g., Epimatrix™ and Epimer™, Brown University; and BIMAS).

Motif bearing subsequences of all 184P1E2 variant proteins are set forth and identified in Tables V–XVIII and XXII–LI.

Table XIX sets forth several frequently occurring motifs based on pfam searches. The columns of Table XIX list (1) motif name abbreviation, (2) percent identity found amongst the different member of the motif family, (3) motif name or description and (4) most common function; location information is included if the motif is relevant for location.

Polypeptides comprising one or more of the 184P1E2 motifs discussed above are useful in elucidating the specific characteristics of a malignant phenotype in view of the observation that the 184P1E2 motifs discussed above are associated with growth dysregulation and because 184P1E2 is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165–174 (1998); Gaiddon et al., Endocrinology 136(10): 4331–4338 (1995); Hall et al., Nucleic Acids Research 24(6): 1119–1126 (1996); Peterziel et al., Oncogene 18(46): 6322–6329 (1999) and O'Brian, Oncol. Rep. 5(2): 305–309 (1998)). Moreover, both glycosylation and myristoylation are protein modifications also associated with cancer and cancer progression (see e.g. Dennis et al., Biochem. Biophys. Acta 1473(1):21–34 (1999); Raju et al., Exp. Cell Res. 235(1): 145–154 (1997)). Amidation is another protein modification also associated with cancer and cancer progression (see e.g. Treston et al., J. Natl. Cancer Inst. Monogr. (13): 169–175 (1992)).

In another embodiment, proteins of the invention comprise one or more of the immunoreactive epitopes identified in accordance with art-accepted methods, such as the peptides set forth in Tables V–XVIII and XXII–LI. CTL epitopes can be determined using specific algorithms to identify peptides within a 184P1E2 protein that are capable of optimally binding to specified HLA alleles (e.g., Table IV; Epimatrix™ and Epimer™, Brown University; and BIMAS). Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, one can substitute out a deleterious residue in favor of any other residue, such as a preferred residue as defined in Table IV; substitute a less-preferred residue with a preferred residue as defined in Table IV; or substitute an originally-occurring preferred residue with another preferred residue as defined in Table IV. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al.; Sette, Immunogenetics 1999 50(3–4): 201–212; Sette et al., J. Immunol. 2001 166(2): 1389–1397; Sidney et al., Hum. Immunol. 1997 58(1): 12–20; Kondo et al., Immunogenetics 1997 45(4): 249–258; Sidney et al., J. Immunol. 1996 157(8): 3480–90; and Falk et al., Nature 351: 290–6 (1991); Hunt et al., Science 255:1261–3 (1992); Parker et al., J. Immunol. 149:3580–7 (1992); Parker et al., J. Immunol. 152:163–75 (1994)); Kast et al., 1994 152(8): 3904–12; Borras-Cuesta et al., Hum. Immunol. 2000 61(3): 266–278; Alexander et al., J. Immunol. 2000 164(3); 164(3): 1625–1633; Alexander et al., PMID: 7895164, UI: 95202582; O'Sullivan et al., J. Immunol. 1991 147(8): 2663–2669; Alexander et al., Immunity 1994 1(9): 751–761 and Alexander et al., Immunol. Res. 1998 18(2): 79–92.

Related embodiments of the invention include polypeptides comprising combinations of the different motifs set forth in Table XX, and/or, one or more of the predicted CTL epitopes of Tables V–XVII and XXII–XLVII, and/or, one or more of the predicted HTL epitopes of Tables XLVIII–LI, and/or, one or more of the T cell binding motifs known in the art. Preferred embodiments contain no insertions, deletions or substitutions either within the motifs or the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically the number of N-terminal and/or C-terminal amino acid residues on either side of a motif is between about 1 to about 100 amino acid residues, preferably 5 to about 50 amino acid residues.

184P1E2-related proteins are embodied in many forms, preferably in isolated form. A purified 184P1E2 protein molecule will be substantially free of other proteins or molecules that impair the binding of 184P1E2 to antibody, T cell or other ligand. The nature and degree of isolation and purification will depend on the intended use. Embodiments of a 184P1E2-related proteins include purified 184P1E2-related proteins and functional, soluble 184P1E2-related proteins. In one embodiment, a functional, soluble 184P1E2 protein or fragment thereof retains the ability to be bound by antibody, T cell or other ligand.

The invention also provides 184P1E2 proteins comprising biologically active fragments of a 184P1E2 amino acid sequence shown in FIG. 2 or FIG. 3. Such proteins exhibit properties of the starting 184P1E2 protein, such as the ability to elicit the generation of antibodies that specifically bind an epitope associated with the starting 184P1E2 protein; to be bound by such antibodies; to elicit the activation of HTL or CTL; and/or, to be recognized by HTL or CTL that also specifically bind to the starting protein.

184P1E2-related polypeptides that contain particularly interesting structures can be predicted and/or identified using various analytical techniques well known in the an, including, for example, the methods of Chou-Fasman, Garnier-Robson, Kyte-Doolittle, Eisenberg, Karplus-Schultz or Jameson-Wolf analysis, or on the basis of immunogenicity. Fragments that contain such structures are particularly useful in generating subunit-specific anti-184P1E2 antibodies, or T cells or in identifying cellular factors that bind to 184P1E2. For example, hydrophilicity profiles can be generated, and immunogenic peptide fragments identified, using the method of Hopp, T. P. and Woods, K. R., 1981, Proc. Natl. Acad. Sci. U.S.A. 78:3824–3828. Hydropathicity profiles can be generated, and immunogenic peptide fragments identified, using the method of Kyte, J. and Doolittle, R. F., 1982, J. Mol. Biol. 157:105–132. Percent (%) Accessible Residues profiles can be generated, and immunogenic peptide fragments identified, using the method of Janin J., 1979, Nature 277:491–492. Average Flexibility profiles can be generated, and immunogenic peptide fragments identified, using the method of Bhaskaran R., Ponnuswamy P. K., 1988, Int. J. Pept. Protein Res. 32:242–255. Beta-turn profiles can be generated, and immunogenic peptide fragments identified, using the method of Deleage, G., Roux B., 1987, Protein Engineering 1:289–294.

CTL epitopes can be determined using specific algorithms to identify peptides within a 184P1E2 protein that are capable of optimally binding to specified HLA alleles (e.g., by using the SYFPEIFHI site; the listings in Table IV(A)–(E); Epimatrix™ and Epimer™, Brown University; and BIMAS). Illustrating this, peptide epitopes from 184P1E2 that are presented in the context of human MHC Class I molecules, e.g., HLA-A1, A2, A3, A11, A24, B7 and B35 were predicted (see, e.g., Tables V–XVIII, XXII–LI). Specifically, the complete amino acid sequence of the 184P1E2 protein and relevant portions of other variants, i.e., for HLA Class I predictions 9 flanking residues on either side of a point mutation, and for HLA Class II predictions 14 flanking residues on either side of a point mutation, were entered into the HLA Peptide Motif Search algorithm found in the Bioinformatics and Molecular Analysis Section (BIMAS) web site listed above; in addition to the site SYFPEITHI.

The HLA peptide motif search algorithm was developed by Dr. Ken Parker based on binding of specific peptide sequences in the groove of HLA Class I molecules, in particular HLA-A2 (see, e.g., Falk et al., Nature 351: 290–6 (1991); Hunt et al., Science 255:1261–3 (1992); Parker et al., J. Immunol. 149:3580–7 (1992); Parker et al., J. Immunol. 152:163–75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149:3580–7 (1992)). Selected results of 184P1E2 predicted binding peptides are shown in Tables V–XVIII and XXII-LI herein. In Tables V–XVIII and XXI-I–XLVII, selected candidates, 9-mers and 10-mers, for each family member are shown along with their location, the amino acid sequence of each specific peptide, and an estimated binding score. In Tables XLVIII–LI, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73–8 (1997) and Peshwa et al., Prostate 36:129–38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using BIMAS) are to be "applied" to a 184P1E2 protein in accordance with the invention. As used in this context "applied" means that a 184P1E2 protein is evaluated, e.g., visually or by computer-based patterns finding methods, as appreciated by those of skill in the relevant art. Every subsequence of a 184P1E2 protein of 8, 9, 10, or 11 amino acid residues that bears an HLA Class I motif, or a subsequence of 9 or more amino acid residues that bear an HLA Class II motif are within the scope of the invention.

III.B.) Expression of 184P1E2-Related Proteins

In an embodiment described in the examples that follow, 184P1E2 can be conveniently expressed in cells (such as 293T cells) transfected with a commercially available expression vector such as a CMV-driven expression vector encoding 184P1E2 with a C-terminal 6XHis and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted 184P1E2 protein in transfected cells. The secreted HIS-tagged 184P1E2 in the culture media can be purified, e.g., using a nickel column using standard techniques.

III.C.) Modifications of 184P1E2-Related Proteins

Modifications of 184P1E2-related proteins such as covalent modifications are included within the scope of this invention. One type of covalent modification includes reacting targeted amino acid residues of a 184P1E2 polypeptide with an organic derivatizing agent that is capable of reacting with selected side chains or the N- or C-terminal residues of a 184P1E2 protein. Another type of covalent modification of a 184P1E2 polypeptide included within the scope of this invention comprises altering the native glycosylation pattern of a protein of the invention. Another type of covalent modification of 184P1E2 comprises linking a 184P1E2 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or U.S. Pat. No. 4,179,337.

The 184P1E2-related proteins of the present invention can also be modified to form a chimeric molecule comprising 184P1E2 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 184P1E2 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 184P1E2. A chimeric molecule can comprise a fusion of a 184P1E2-related protein with a polyhistidine epitope tag, which provides an epitope to which immobilized nickel can selectively bind, with cytokines or with growth factors. The epitope tag is generally placed at the amino- or carboxyl-terminus of a 184P1E2 protein. In an alternative embodiment, the chimeric molecule can comprise a fusion of a 184P1E2-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 184P1E2 polypeptide in place of at least one variable region within an Ig molecule. In a preferred embodiment, the immunoglobulin fusion includes the hinge, CH2 and CH3, or the hinge, CH1, CH2 and CH3 regions of an IgGI molecule. For the production of immunoglobulin fusions see, e.g., U.S. Pat. No. 5,428,130 issued Jun. 27, 1995.

III.D.) Uses of 184P1E2-Related Proteins

The proteins of the invention have a number of different specific uses. As 184P1E2 is highly expressed in prostate and other cancers, 184P1E2-related proteins are used in methods that assess the status of 184P1E2 gene products in normal versus cancerous tissues, thereby elucidating the malignant phenotype. Typically, polypeptides from specific regions of a 184P1E2 protein are used to assess the presence of perturbations (such as deletions, insertions, point mutations etc.) in those regions (such as regions containing one or more motifs). Exemplary assays utilize antibodies or T cells targeting 184P1E2-related proteins comprising the amino acid residues of one or more of the biological motifs contained within a 184P1E2 polypeptide sequence in order to evaluate the characteristics of this region in normal versus cancerous tissues or to elicit an immune response to the epitope. Alternatively, 184P1E2-related proteins that contain the amino acid residues of one or more of the biological motifs in a 184P1E2 protein are used to screen for factors that interact with that region of 184P1E2.

184P1E2 protein fragments/subsequences are particularly useful in generating and characterizing domain-specific antibodies (e.g., antibodies recognizing an extracellular or intracellular epitope of a 184P1E2 protein), for identifying agents or cellular factors that bind to 184P1E2 or a particular structural domain thereof, and in various therapeutic and diagnostic contexts, including but not limited to diagnostic assays, cancer vaccines and methods of preparing such vaccines.

Proteins encoded by the 184P1E2 genes, or by analogs, homologs or fragments thereof, have a variety of uses, including but not limited to generating antibodies and in methods for identifying ligands and other agents and cellular constituents that bind to a 184P1E2 gene product. Antibodies raised against a 184P1E2 protein or fragment thereof are useful in diagnostic and prognostic assays, and imaging methodologies in the management of human cancers characterized by expression of 184P1E2 protein, such as those listed in Table I. Such antibodies can be expressed intracellularly and used in methods of treating patients with such cancers. 184P1E2-related nucleic acids or proteins are also used in generating HTL or CTL responses.

Various immunological assays useful for the detection of 184P1E2 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 184P1E2-expressing cells (e.g., in radioscintigraphic imaging methods). 184P1E2 proteins are also particularly useful in generating cancer vaccines, as further described herein.

IV.) 184P1E2 Antibodies

Another aspect of the invention provides antibodies that bind to 184P1E2-related proteins. Preferred antibodies specifically bind to a 184P1E2-related protein and do not bind (or bind weakly) to peptides or proteins that are not 184P1E2-related proteins. For example, antibodies that bind 184P1E2 can bind 184P1E2-related proteins such as the homologs or analogs thereof.

184P1E2 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 184P1E2 is also expressed or overexpressed in these other cancers. Moreover, intracellularly expressed antibodies (e.g., single chain antibodies) are therapeutically useful in treating cancers in which the expression of 184P1E2 is involved, such as advanced or metastatic prostate cancers.

The invention also provides various immunological assays useful for the detection and quantification of 184P1E2 and mutant 184P1E2-related proteins. Such assays can comprise one or more 184P1E2 antibodies capable of recognizing and binding a 184P1E2-related protein, as appropriate. These assays are performed within various immunological assay formats well known in the art, including but not limited to various types of radioimmunoassays, enzymes-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 184P1E2 are also provided by the invention, including but not limited to radioscintigraphic imaging methods using labeled 184P1E2 antibodies. Such assays are clinically useful in the detection, monitoring, and prognosis of 184P1E2 expressing cancers such as prostate cancer.

184P1E2 antibodies are also used in methods for purifying a 184P1E2-related protein and for isolating 184P1E2 homologues and related molecules. For example, a method of purifying a 184P1E2-related protein comprises incubating a 184P1E2 antibody, which has been coupled to a solid matrix, with a lysate or other solution containing a 184P1E2-related protein under conditions that permit the 184P1E2 antibody to bind to the 184P1E2-related protein; washing the solid matrix to eliminate impurities; and eluting the 184P1E2-related protein from the coupled antibody. Other uses of 184P1E2 antibodies in accordance with the invention include generating anti-idiotypic antibodies that mimic a 184P1E2 protein.

Various methods for the preparation of antibodies are well known in the art. For example, antibodies can be prepared by immunizing a suitable mammalian host using a 184P1E2-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 184P1E2 can also be used, such as a 184P1E2 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 184P1E2-related protein is synthesized and used as an immunogen.

In addition, naked DNA immunization techniques known in the art are used (with or without purified 184P1E2-related protein or 184P1E2 expressing cells) to generate an immune response to the encoded immunogen (for review, see Donnelly et al., 1997, Ann. Rev. Immunol. 15:617–648).

The amino acid sequence of a 184P1E2 protein as shown in FIG. 2 or FIG. 3 can be analyzed to select specific regions of the 184P1E2 protein for generating antibodies. For example, hydrophobicity and hydrophilicity analyses of a 184P1E2 amino acid sequence are used to identify hydrophilic regions in the 184P1E2 structure. Regions of a 184P1E2 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824–3828. Hydropathicity profiles can be generated using the method of Kyte, J. and Doolittle, R. F., 1982, J. Mol. Biol. 157:105–132. Percent (%) Accessible Residues profiles can be generated using the method of Janin J., 1979, Nature 277:491–492. Average Flexibility profiles can be generated using the method of Bhaskaran R., Ponnuswamy P. K., 1988, Int. J. Pept. Protein Res. 32:242–255. Beta-turn profiles can be generated using the method of Deleage, G., Roux B., 1987, Protein Engineering 1:289–294. Thus, each region identified by any of these programs or methods is within the scope of the present invention. Methods for the generation of 184P1E2 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 184P1E2 immunogen is often conducted by injection over a suitable time period and with use of a suitable adjuvant, as is understood in the art. During the immunization schedule, titers of antibodies can be taken to determine adequacy of antibody formation.

184P1E2 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 184P1E2-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 184P1E2 protein can also be produced in the context of chimeric or complementarity determining region (CDR) grafted antibodies of multiple species origin. Humanized or human 184P1E2 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522–525; Riechmann et al., 1988, Nature 332: 323–327; Verhoeyen et al., 1988, Science 239: 1534–1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535–539). Fully human 184P1E2 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45–64 (1993); Burton and Barbas, Human Antibodies from combinatorial libraries. Id., pp 65–82). Fully human 184P1E2 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607–614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 184P1E2 antibodies with a 184P1E2-related protein can be established by a number of well known means, including Western blot, immunoprecipitation, ELISA, and FACS analyses using, as appropriate, 184P1E2-related proteins, 184P1E2-expressing cells or extracts thereof. A 184P1E2 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 184P1E2 epitopes are generated using methods generally known in the art. Homodimeric antibodies can also be generated by cross-linking techniques known in the art (e.g., Wolff et al., Cancer Res. 53: 2560–2565).

V.) 184P1E2 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317:359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., *J. Immunol.* 160:3363, 1998; Rammensee, et al., *Immunogenetics* 41:178, 1995; Rammensee et al., SYFPEITHI; Sette, A. and Sidney, J. *Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, J. *Curr. Biol.* 6:52, 1994; Ruppert et al., *Cell* 74:929–937, 1993; Kondo et al., *J. Immunol.* 155:4307–4312, 1995; Sidney et al., *J. Immunol.* 157:3480–3490, 1996; Sidney et al., *Human Immunol.* 45:79–93, 1996; Sette, A. and Sidney, J. *Immunogenetics* 1999 November; 50(3–4):201–12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al, *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1–2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 184P1E2 Transgenic Animals

Nucleic acids that encode a 184P1E2-related protein can also be used to generate either transgenic animals or "knock out" animals that, in turn, are useful in the development and screening of therapeutically useful reagents. In accordance with established techniques, cDNA encoding 184P1E2 can be used to clone genomic DNA that encodes 184P1E2. The cloned genomic sequences can then be used to generate transgenic animals containing cells that express DNA that encode 184P1E2. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 184P1E2 transgene incorporation with tissue-specific enhancers.

Transgenic animals that include a copy of a transgene encoding 184P1E2 can be used to examine the effect of increased expression of DNA that encodes 184P1E2. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 184P1E2 can be used to construct a 184P1E2 "knock out" animal that has a defective or altered gene encoding 184P1E2 as a result of homologous recombination between the endogenous gene encoding 184P1E2 and altered genomic DNA encoding 184P1E2 introduced into an embryonic cell of the animal. For example, cDNA that encodes 184P1E2 can be used to clone genomic DNA encoding 184P1E2 in accordance with established techniques. A portion of the genomic DNA encoding 184P1E2 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell,* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach*, E. J. Robertson, ed. (IRL, Oxford, 1987), pp. 113–152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 184P1E2 polypeptide.

VII.) Methods for the Detection of 184P1E2

Another aspect of the present invention relates to methods for detecting 184P1E2 polynucleotides and 184P1E2-related proteins, as well as methods for identifying a cell that expresses 184P1E2. The expression profile of 184P1E2 makes it a diagnostic marker for metastasized disease. Accordingly, the status of 184P1E2 gene products provides information useful for predicting a variety of factors including susceptibility to advanced stage disease, rate of progression, and/or tumor aggressiveness. As discussed in detail herein, the status of 184P1E2 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 184P1E2 polynucleotides in a biological sample, such as serum, bone, prostate, and other tissues, urine, semen, cell preparations, and the like. Detectable 184P1E2 polynucleotides include, for example, a 184P1E2 gene or fragment thereof, 184P1E2 mRNA, alternative splice variant 184P1E2 mRNAs, and recombinant DNA or RNA molecules that contain a 184P1E2 polynucleotide. A number of methods for amplifying and/or detecting the presence of 184P1E2 polynucleotides are well known in the art and can be employed in the practice of this aspect of the invention.

In one embodiment, a method for detecting a 184P1E2 mRNA in a biological sample comprises producing cDNA from the sample by reverse transcription using at least one primer; amplifying the cDNA so produced using a 184P1E2 polynucleotides as sense and antisense primers to amplify 184P1E2 cDNAs therein; and detecting the presence of the amplified 184P1E2 cDNA. Optionally, the sequence of the amplified 184P1E2 cDNA can be determined.

In another embodiment, a method of detecting a 184P1E2 gene in a biological sample comprises first isolating genomic DNA from the sample; amplifying the isolated genomic DNA using 184P1E2 polynucleotides as sense and antisense primers; and detecting the presence of the amplified 184P1E2 gene. Any number of appropriate sense and antisense probe combinations can be designed from a 184P1E2 nucleotide sequence (see, e.g., FIG. 2) and used for this purpose.

The invention also provides assays for detecting the presence of a 184P1E2 protein in a tissue or other biological sample such as serum, semen, bone, prostate, urine, cell preparations, and the like. Methods for detecting a 184P1E2-related protein are also well known and include, for example, immunoprecipitation, immunohistochemical analysis, Western blot analysis, molecular binding assays, ELISA, ELIFA and the like. For example, a method of detecting the presence of a 184P1E2-related protein in a biological sample comprises first contacting the sample with a 184P1E2 antibody, a 184P1E2-reactive fragment thereof, or a recombinant protein containing an antigen binding region of a 184P1E2 antibody; and then detecting the binding of 184P1E2-related protein in the sample. Methods for identifying a cell that expresses 184P1E2 are also within the scope of the invention. In one embodiment, an assay for identifying a cell that expresses a 184P1E2 gene comprises detecting the presence of 184P1E2 mRNA in the cell. Methods for the detection of particular mRNAs in cells are well known and include, for example, hybridization assays using complementary DNA probes (such as in situ hybridization using labeled 184P1E2 riboprobes, Northern blot and related techniques) and various nucleic acid amplification assays (such as RT-PCR using complementary primers specific for 184P1E2, and other amplification type detection methods, such as, for example, branched DNA, SISBA, TMA and the like). Alternatively, an assay for identifying a cell that expresses a 184P1E2 gene comprises detecting the presence of 184P1E2-related protein in the cell or secreted by the cell. Various methods for the detection of proteins are well known in the art and are employed for the detection of 184P1E2-related proteins and cells that express 184P1E2-related proteins.

184P1E2 expression analysis is also useful as a tool for identifying and evaluating agents that modulate 184P1E2 gene expression. For example, 184P1E2 expression is significantly upregulated in prostate cancer, and is expressed in cancers of the tissues listed in Table I. Identification of a molecule or biological agent that inhibits 184P1E2 expression or over-expression in cancer cells is of therapeutic value. For example, such an agent can be identified by using a screen that quantifies 184P1E2 expression by RT-PCR, nucleic acid hybridization or antibody binding.

VIII.) Methods for Monitoring the Status of 184P1E2-Related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437–438 (1997) and Isaacs et al., Cancer Surv. 23: 19–32 (1995)). In this context, examining a biological sample for evidence of dysregulated cell growth (such as aberrant 184P1E2 expression in cancers) allows for early detection of such aberrant physiology, before a pathologic state such as cancer has progressed to a stage that therapeutic options are more limited and or the prognosis is worse. In such examinations, the status of 184P1E2 in a biological sample of interest can be compared, for example, to the status of 184P1E2 in a corresponding normal sample (e.g. a sample from that individual or alternatively another individual that is not affected by a pathology). An alteration in the status of 184P1E2 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306–14 and U.S. Pat. No. 5,837,501) to compare 184P1E2 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 184P1E2 expressing cells) as well as the level, and biological activity of expressed gene products (such as 184P1E2 mRNA, polynucleotides and polypeptides). Typically, an alteration in the status of 184P1E2 comprises a change in the location of 184P1E2 and/or 184P1E2 expressing cells and/or an increase in 184P1E2 mRNA and/or protein expression.

184P1E2 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 184P1E2 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 184P1E2 in a biological sample is evaluated by various methods utilized by skilled artisans including, but not limited to genomic Southern analysis (to examine, for example perturbations in a 184P1E2 gene), Northern analysis and/or PCR analysis of 184P1E2 mRNA (to examine, for example alterations in the polynucleotide sequences or expression levels of 184P1E2 mRNAs), and, Western and/or immunohistochemical analysis (to examine, for example alterations in polypeptide sequences, alterations in polypeptide localization within a sample, alterations in expression levels of 184P1E2 proteins and/or associations of 184P1E2 proteins with polypeptide binding partners). Detectable 184P1E2 polynucleotides include, for example, a 184P1E2 gene or fragment thereof, 184P1E2 mRNA, alternative splice variants, 184P1E2 mRNAs, and recombinant DNA or RNA molecules containing a 184P1E2 polynucleotide.

The expression profile of 184P1E2 makes it a diagnostic marker for local and/or metastasized disease, and provides information on the growth or oncogenic potential of a biological sample. In particular, the status of 184P1E2 provides information useful for predicting susceptibility to particular disease stages, progression, and/or tumor aggressiveness. The invention provides methods and assays for determining 184P1E2 status and diagnosing cancers that express 184P1E2, such as cancers of the tissues listed in Table I. For example, because 184P1E2 mRNA is so highly expressed in prostate and other cancers relative to normal prostate tissue, assays that evaluate the levels of 184P1E2 mRNA transcripts or proteins in a biological sample can be used to diagnose a disease associated with 184P1E2 dysregulation, and can provide prognostic information useful in defining appropriate therapeutic options.

The expression status of 184P1E2 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 184P1E2 in biological samples such as those from individuals suffering from, or suspected of suffering from a pathology characterized by dysregulated cellular growth, such as cancer.

As described above, the status of 184P1E2 in a biological sample can be examined by a number of well-known procedures in the art. For example, the status of 184P1E2 in a biological sample taken from a specific location in the body can be examined by evaluating the sample for the presence or absence of 184P1E2 expressing cells (e.g. those that express 184P1E2 mRNAs or proteins). This examination can provide evidence of dysregulated cellular growth, for example, when 184P1E2-expressing cells are found in a biological sample that does not normally contain such cells (such as a lymph node), because such alterations in the status of 184P1E2 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315–317 (2000); Su et al., Semin. Surg. Oncol. 18(1): 17–28 (2000) and Freeman et al., J Urol 1995 August 154(2 Pt 1):474–8).

In one aspect, the invention provides methods for monitoring 184P1E2 gene products by determining the status of 184P1E2 gene products expressed by cells from an individual suspected of having a disease associated with dysregulated cell growth (such as hyperplasia or cancer) and then comparing the status so determined to the status of 184P1E2 gene products in a corresponding normal sample. The presence of aberrant 184P1E2 gene products in the test sample relative to the normal sample provides an indication of the presence of dysregulated cell growth within the cells of the individual.

In another aspect, the invention provides assays useful in determining the presence of cancer in an individual, comprising detecting a significant increase in 184P1E2 mRNA or protein expression in a test cell or tissue sample relative to expression levels in the corresponding normal cell or tissue. The presence of 184P1E2 mRNA can, for example, be evaluated in tissues including but not limited to those listed in Table I. The presence of significant 184P1E2 expression in any of these tissues is useful to indicate the emergence, presence and/or severity of a cancer, since the corresponding normal tissues do not express 184P1E2 mRNA or express it at lower levels.

In a related embodiment, 184P1E2 status is determined at the protein level rather than at the nucleic acid level. For example, such a method comprises determining the level of 184P1E2 protein expressed by cells in a test tissue sample and comparing the level so determined to the level of 184P1E2 expressed in a corresponding normal sample. In one embodiment, the presence of 184P1E2 protein is evaluated, for example, using immunohistochemical methods. 184P1E2 antibodies or binding partners capable of detecting 184P1E2 protein expression are used in a variety of assay formats well known in the art for this purpose.

In a further embodiment, one can evaluate the status of 184P1E2 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369–378). For example, a mutation in the sequence of 184P1E2 may be indicative of the presence or promotion of a tumor. Such assays therefore have diagnostic and predictive value where a mutation in 184P1E2 indicates a potential loss of function or increase in tumor growth.

A wide variety of assays for observing perturbations in nucleotide and amino acid sequences are well known in the art. For example, the size and structure of nucleic acid or amino acid sequences of 184P1E2 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a 184P1E2 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985–1992 (1999)). In addition, this alteration is present in at least 70% of cases of high-grade prostatic intraepithelial neoplasia (PIN) (Brooks et al., Cancer Epidemiol. Biomarkers Prev., 1998, 7:531–536). In another example, expression of the LAGE-1 tumor specific gene (which is not expressed in normal prostate but is expressed in 25–50% of prostate cancers) is induced by deoxy-azacytidine in lymphoblastoid cells, suggesting that tumoral expression is due to demethylation (Lethe et al., Int. J. Cancer 76(6): 903–908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 184P1E2. Gene amplification is measured in a sample directly, for example, by conventional Southern blotting or Northern blotting to quantitate the transcription of mRNA (Thomas, 1980, Proc. Natl. Acad. Sci. USA, 77:5201–5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 184P1E2 expression. The presence of RT-PCR amplifiable 184P1E2 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373–384; Ghossein et al., 1995, J. Clin. Oncol. 13:1195–2000; Heston et al., 1995, Clin. Chem. 41:1687–1688).

A further aspect of the invention is an assessment of the susceptibility that an individual has for developing cancer. In one embodiment, a method for predicting susceptibility to cancer comprises detecting 184P1E2 mRNA or 184P1E2 protein in a tissue sample, its presence indicating susceptibility to cancer, wherein the degree of 184P1E2 mRNA expression correlates to the degree of susceptibility. In a specific embodiment, the presence of 184P1E2 in prostate or other tissue is examined, with the presence of 184P1E2 in the sample providing an indication of prostate cancer susceptibility (or the emergence or existence of a prostate tumor). Similarly, one can evaluate the integrity 184P1E2 nucleotide and amino acid sequences in a biological sample, in order to identify perturbations in the structure of these molecules such as insertions, deletions, substitutions and the like. The presence of one or more perturbations in 184P1E2 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 184P1E2 mRNA or 184P1E2 protein expressed by tumor cells, comparing the level so determined to the level of 184P1E2 mRNA or 184P1E2 protein expressed in a corresponding normal tissue taken from the same individual or a normal tissue reference sample, wherein the degree of 184P1E2 mRNA or 184P1E2 protein expression in the tumor sample relative to the normal sample indicates the degree of aggressiveness. In a specific embodiment, aggressiveness of a tumor is evaluated by determining the extent to which 184P1E2 is expressed in the tumor cells, with higher expression levels indicating more aggressive tumors. Another embodiment is the evaluation of the integrity of 184P1E2 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 184P1E2 mRNA or 184P1E2 protein expressed by cells in a sample of the tumor, comparing the level so determined to the level of 184P1E2 mRNA or 184P1E2 protein expressed in an equivalent tissue sample taken from the same individual at a different time, wherein the degree of 184P1E2 mRNA or 184P1E2 protein expression in the tumor sample over time provides information on the progression of the cancer. In a specific embodiment, the progression of a cancer is evaluated by determining 184P1E2 expression in the tumor cells over time, where increased expression over time indicates a progression of the cancer. Also, one can evaluate the integrity 184P1E2 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 184P1E2 gene and 184P1E2 gene products (or perturbations in 184P1E2 gene and 184P1E2 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74–88; Epstein, 1995, Hum. Pathol. 26(2):223–9; Thorson et al., 1998, Mod. Pathol. 11 (6):543–51; Baisden et al., 1999, Am. J. Surg. Pathol. 23(8):918–24). Methods for observing a coincidence between the expression of 184P1E2 gene and 184P1E2 gene products (or perturbations in 184P1E2 gene and 184P1E2 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 184P1E2 gene and 184P1E2 gene products (or perturbations in 184P1E2 gene and 184P1E2 gene products) and another factor associated with malignancy entails detecting the overexpression of 184P1E2 mRNA or protein in a tissue sample, detecting the overexpression of PSA mRNA or protein in a tissue sample (or PSCA or PSM expression), and observing a coincidence of 184P1E2 mRNA or protein and PSA mRNA or protein overexpression (or PSCA or PSM expression). In a specific embodiment, the expression of 184P1E2 and PSA mRNA in prostate tissue is examined, where the coincidence of 184P1E2 and PSA RNA overexpression in the sample indicates the existence of prostate cancer, prostate cancer susceptibility or the emergence or status of a prostate tumor.

Methods for detecting and quantifying the expression of 184P1E2 mRNA or protein are described herein, and standard nucleic acid and protein detection and quantification technologies are well known in the art Standard methods for the detection and quantification of 184P1E2 mRNA include in situ hybridization using labeled 184P1E2 riboprobes, Northern blot and related techniques using 184P1E2 polynucleotide probes, RT-PCR analysis using primers specific for 184P1E2, and other amplification type detection methods, such as, for example, branched DNA, SISBA, TMA and the like. In a specific embodiment, semi-quantitative RT-PCR is used to detect and quantify 184P1E2 mRNA expression. Any number of primers capable of amplifying 184P1E2 can be used for this purpose, including but not limited to the various primer sets specifically described herein. In a specific embodiment, polyclonal or monoclonal antibodies specifically reactive with the wild-type 184P1E2 protein can be used in an immunohistochemical assay of biopsied tissue.

IX.) Identification of Molecules That Interact With 184P1E2

The 184P1E2 protein and nucleic acid sequences disclosed herein allow a skilled artisan to identify proteins, small molecules and other agents that interact with 184P1E2, as well as pathways activated by 184P1E2 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein—protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83–86).

Alternatively one can screen peptide libraries to identify molecules that interact with 184P1E2 protein sequences. In such methods, peptides that bind to 184P1E2 are identified by screening libraries that encode a random or controlled collection of amino acids. Peptides encoded by the libraries are expressed as fusion proteins of bacteriophage coat proteins, the bacteriophage particles are then screened against the 184P1E2 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 184P1E2 protein sequences are disclosed for example in U.S. Pat. No. 5,723,286 issued 3 Mar. 1998 and U.S. Pat. No. 5,733,731 issued 31 Mar. 1998.

Alternatively, cell lines that express 184P1E2 are used to identify protein—protein interactions mediated by 184P1E2. Such interactions can be examined using immunoprecipitation techniques (see, e.g., Hamilton B. J., et al. Biochem. Biophys. Res. Commun. 1999, 261:646–51). 184P1E2 protein can be immunoprecipitated from 184P1E2-expressing cell lines using anti-184P1E2 antibodies. Alternatively, antibodies against His-tag can be used in a cell line engineered to express fusions of 184P1E2 and a His-tag (vectors mentioned above). The immunoprecipitated complex can be examined for protein association by procedures such as Western blotting, $^{35}$S methionine labeling of proteins, protein microsequencing, silver staining and two-dimensional gel electrophoresis.

Small molecules and ligands that interact with 184P1E2 can be identified through related embodiments of such screening assays. For example, small molecules can be identified that interfere with protein function, including molecules that interfere with 184P1E2's ability to mediate phosphorylation and de-phosphorylation, interaction with DNA or RNA molecules as an indication of regulation of cell cycles, second messenger signaling or tumorigenesis. Similarly, small molecules that modulate 184P1E2-related ion channel, protein pump, or cell communication functions are identified and used to treat patients that have a cancer that expresses 184P1E2 (see, e.g., Hille, B., Ionic Channels of Excitable Membranes $2^{nd}$ Ed., Sinauer Assoc., Sunderland, M A, 1992). Moreover, ligands that regulate 184P1E2 function can be identified based on their ability to bind 184P1E2 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 184P1E2 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators which activate or inhibit 184P1E2.

An embodiment of this invention comprises a method of screening for a molecule that interacts with a 184P1E2 amino acid sequence shown in FIG. 2 or FIG. 3, comprising the steps of contacting a population of molecules with a 184P1E2 amino acid sequence, allowing the population of molecules and the 184P1E2 amino acid sequence to interact under conditions that facilitate an interaction, determining the presence of a molecule that interacts with the 184P1E2 amino acid sequence, and then separating molecules that do not interact with the 184P1E2 amino acid sequence from molecules that do. In a specific embodiment, the method further comprises purifying, characterizing and identifying a molecule that interacts with the 184P1E2 amino acid sequence. The identified molecule can be used to modulate a function performed by 184P1E2. In a preferred embodiment, the 184P1E2 amino acid sequence is contacted with a library of peptides.

X.) Therapeutic Methods and Compositions

The identification of 184P1E2 as a protein that is normally expressed in a restricted set of tissues, but which is also expressed in prostate and other cancers, opens a number of therapeutic approaches to the treatment of such cancers. As contemplated herein, 184P1E2 functions as a transcription factor involved in activating tumor-promoting genes or repressing genes that block tumorigenesis.

Accordingly, therapeutic approaches that inhibit the activity of a 184P1E2 protein are useful for patients suffering from a cancer that expresses 184P1E2. These therapeutic approaches generally fall into two classes. One class comprises various methods for inhibiting the binding or association of a 184P1E2 protein with its binding partner or with other proteins. Another class comprises a variety of methods for inhibiting the transcription of a 184P1E2 gene or translation of 184P1E2 mRNA.

X.A.) Anti-Cancer Vaccines

The invention provides cancer vaccines comprising a 184P1E2-related protein or 184P1E2-related nucleic acid. In view of the expression of 184P1E2, cancer vaccines prevent and/or treat 184P1E2-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231–237; Fong et al., 1997, J. Immunol. 159:3113–3117).

Such methods can be readily practiced by employing a 184P1E2-related protein, or a 184P1E2-encoding nucleic acid molecule and recombinant vectors capable of expressing and presenting the 184P1E2 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 Feb. 31(1):66–78; Maruyama et al., Cancer Immunol Immunother 2000 June 49(3):123–32) Briefly, such methods of generating an immune response (e.g. humoral and/or cell-mediated) in a mammal, comprise the steps of: exposing the mammal's immune system to an immunoreactive epitope (e.g. an epitope present in a 184P1E2 protein shown in FIG. 3 or analog or homolog thereof) so that the mammal generates an immune response that is specific for that epitope (e.g. generates antibodies that specifically recognize that epitope). In a preferred method, a 184P1E2 immunogen contains a biological motif, see e.g., Tables V–XVIII and XXII–LI, or a peptide of a size range from 184P1E2 indicated in FIG. 5, FIG. 6, FIG. 7, FIG. 8, and FIG. 9.

The entire 184P1E2 protein, immunogenic regions or epitopes thereof can be combined and delivered by various means. Such vaccine compositions can include, for example, lipopeptides (e.g., Vitiello, A. et al., J. Clin. Invest. 95:341, 1995), peptide compositions encapsulated in poly(DL-lactide-co-glycolide) ("PLG") microspheres (see, e.g., Eldridge, et al., Molec. Immunol 28:287–294, 1991: Alonso et al., Vaccine 12:299–306, 1994; Jones et al., Vaccine 13:675–681, 1995), peptide compositions contained in immune stimulating complexes (ISCOMS) (see, e.g., Takahashi et al., Nature 344:873–875, 1990; Hu et al., Clin Exp Immunol 113:235–243, 1998), multiple antigen peptide systems (MAPs) (see e.g., Tam, J. P., Proc. Natl. Acad. Sci. USA. 85:5409–5413, 1988; Tam, J. P., J. Immunol. Methods 196:17–32, 1996), peptides formulated as multivalent peptides; peptides for use in ballistic delivery systems, typically crystallized peptides, viral delivery vectors (Perkus, M. E. et al., In: Concepts in vaccine development, Kaufmann, S. H. E., ed., p. 379, 1996; Chakrabarti, S. et al., Nature 320:535, 1986; Hu, S. L. et al., Nature 320:537, 1986; Kieny, M.-P. et al., AIDS Bio/Technology 4:790, 1986; Top, F. H. et al., J. Infect. Dis. 124:148, 1971; Chanda, P. K. et al., Virology 175:535, 1990), particles of viral or synthetic origin (e.g., Kofler, N. et al., J. Immunol. Methods. 192:25, 1996; Eldridge, J. H. et al., Sem. Hematol. 30:16, 1993; Falo, L. D., Jr. et al., Nature Med. 7:649, 1995), adjuvants (Warren, H. S., Vogel, F. R., and Chedid, L. A. Annu. Rev. Immunol. 4:369, 1986; Gupta, R. K. et al., Vaccine 11:293, 1993), liposomes (Reddy, R. et al., J. Immunol. 148:1585, 1992; Rock, K. L., Immunol. Today 17:131, 1996), or, naked or particle absorbed cDNA (Ulmer, J. B. et al., Science 259: 1745, 1993; Robinson, H. L., Hunt, L. A., and Webster, R. G., Vaccine 11:957, 1993; Shiver, J. W. et al., In: Concepts in vaccine development, Kaufmann, S. H. E., ed., p. 423, 1996; Cease, K. B., and Berzofsky, J. A., Annu. Rev. Immunol. 12:923, 1994 and Eldridge, J. H. et al., Sem. Hematol. 30:16, 1993). Toxin-targeted delivery technologies, also known as receptor mediated targeting, such as those of Avant Immunotherapeutics, Inc. (Needham, Mass.) may also be used.

In patients with 184P1E2-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 184P1E2 protein that bind corresponding HLA alleles (see e.g., Table IV; Epimer™ and Epimatrix™, Brown University; BIMAS; and SYFPEITHI. In a preferred embodiment, a 184P1E2 immunogen contains one or more amino acid sequences identified using techniques well known in the art, such as the sequences shown in Tables V–XVIII and XXII–LI or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 184P1E2 protein) so that an immune response is generated. A typical embodiment consists of a method for generating an immune response to 184P1E2 in a host, by contacting the host with a sufficient amount of at least one 184P1E2 B cell or cytotoxic T-cell epitope or analog thereof; and at least one periodic interval thereafter re-contacting the host with the 184P1E2 B cell or cytotoxic T-cell epitope or analog thereof. A specific embodiment consists of a method of generating an immune response against a 184P1E2-related protein or a man-made multiepitopic peptide comprising: administering 184P1E2 immunogen (e.g. a 184P1E2 protein or a peptide fragment thereof, a 184P1E2 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625–1633; Alexander et al., Immunity 1994 1(9): 751–761 and Alexander et al., Immunol. Res. 1998 18(2): 79–92). An alternative method comprises generating an immune response in an individual against a 184P1E2 immunogen by: administering in vivo to muscle or skin of the individual's body a DNA molecule that comprises a DNA sequence that encodes a 184P1E2 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 184P1E2, in order to generate a response to the target antigen.

Nucleic Acid Vaccines:

Vaccine compositions of the invention include nucleic acid-mediated modalities. DNA or RNA that encode protein (s) of the invention can be administered to a patient. Genetic immunization methods can be employed to generate prophylactic or therapeutic humoral and cellular immune responses directed against cancer cells expressing 184P1E2. Constructs comprising DNA encoding a 184P1E2-related protein/immunogen and appropriate regulatory sequences can be injected directly into muscle or skin of an individual, such that the cells of the muscle or skin take-up the construct and express the encoded 184P1E2 protein/immunogen. Alternatively, a vaccine comprises a 184P1E2-related protein. Expression of the 184P1E2-related protein immunogen results in the generation of prophylactic or therapeutic humoral and cellular immunity against cells that bear a 184P1E2 protein. Various prophylactic and therapeutic genetic immunization techniques known in the art can be used. Nucleic acid-based delivery is described, for instance, in Wolff et. al., Science 247:1465 (1990) as well as U.S. Pat. Nos. 5,580,859; 5,589,466; 5,804,566; 5,739,118; 5,736, 524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922, 687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658–663; Tsang et al. J. Natl. Cancer Inst. 87:982–990 (1995)). Non-viral delivery systems can also be employed by introducing naked DNA encoding a 184P1E2-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., Nature 351:456–460 (1991). A wide variety of other vectors useful for therapeutic administration or immunization of the peptides of the invention, e.g. adeno and adeno-associated virus vectors, retroviral vectors, Salmonella typhi vectors, detoxified anthrax toxin vectors, and the like, will be apparent to those skilled in the art from the description herein.

Thus, gene delivery systems are used to deliver a 184P1E2-related nucleic acid molecule. In one embodiment, the full-length human 184P1E2 cDNA is employed. In another embodiment, 184P1E2 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present 184P1E2 antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65–69; Murphy et al., 1996, Prostate 29:371–380). Thus, dendritic cells can be used to present 184P1E2 peptides to T cells in the context of MHC class 1 or II molecules. In one embodiment, autologous dendritic cells are pulsed with 184P1E2 peptides capable of binding to MHC class I and/or class II molecules. In another embodiment, dendritic cells are pulsed with the complete 184P1E2 protein. Yet another embodiment involves engineering the overexpression of a 184P1E2 gene in dendritic cells using various implementing vectors known in the art, such as adenovirus (Arthur et al., 1997, Cancer Gene Ther. 4:17–25), retrovirus (Henderson et al., 1996, Cancer Res. 56:3763–3770), lentivirus, adeno-associated virus, DNA transfection (Ribas et al., 1997, Cancer Res. 57:2865–2869), or tumor-derived RNA transfection (Ashley et al., 1997, J. Exp. Med. 186:1177–1182). Cells that express 184P1E2 can also be engineered to express immune modulators, such as GM-CSF, and used as immunizing agents.

X.B.) 184P1E2 as a Target for Antibody-Based Therapy

184P1E2 is an attractive target for antibody-based therapeutic strategies. A number of antibody strategies are known in the art for targeting both extracellular and intracellular molecules (see, e.g., complement and ADCC mediated killing as well as the use of intrabodies). Because 184P1E2 is expressed by cancer cells of various lineages relative to corresponding normal cells, systemic administration of 184P1E2-immunoreactive compositions are prepared that exhibit excellent sensitivity without toxic, non-specific and/or non-target effects caused by binding of the immunoreactive composition to non-target organs and tissues. Antibodies specifically reactive with domains of 184P1E2 are useful to treat 184P1E2-expressing cancers systemically, either as conjugates with a toxin or therapeutic agent, or as naked antibodies capable of inhibiting cell proliferation or function.

184P1E2 antibodies can be introduced into a patient such that the antibody binds to 184P1E2 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 184P1E2, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 184P1E2 sequence shown in FIG. 2 or FIG. 3. In addition, skilled artisans understand that it is routine to conjugate antibodies to cytotoxic agents (see, e.g., Slevers et al. Blood 93:11 3678–3684 (Jun. 1, 1999)). When cytotoxic and/or therapeutic agents are delivered directly to cells, such as by conjugating them to antibodies specific for a molecule expressed by that cell (e.g. 184P1E2), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-184P1E2 antibody) that binds to a marker (e.g. 184P1E2) expressed, accessible to binding or localized on the cell surfaces. A typical embodiment is a method of delivering a cytotoxic and/or therapeutic agent to a cell expressing 184P1E2, comprising conjugating the cytotoxic agent to an antibody that immunospecifically binds to a 184P1E2 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-184P1E2 antibodies can be done in accordance with various approaches that have been successfully employed in the treatment of other types of cancer, including but not limited to colon cancer (Arlen et al., 1998, Crit. Rev. Immunol. 18:133–138), multiple myeloma (Ozaki et al., 1997, Blood 90:3179–3186, Tsunenari et al., 1997, Blood 90:2437–2444), gastric cancer (Kasprzyk et al., 1992, Cancer Res. 52:2771–2776), B-cell lymphoma (Funakoshi et al., 1996, J. Immunother. Emphasis Tumor Immunol. 19:93–101), leukemia (Zhong et al., 1996, Leuk. Res. 20:581–589), colorectal cancer (Moun et al., 1994, Cancer Res. 54:6160–6166; Velders et al., 1995, Cancer Res. 55:4398–4403), and breast cancer (Shepard et al., 1991, J. Clin. Immunol. 11:117–127): Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 184P1E2 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 184P1E2 antibody therapy is useful for all stages of cancer, antibody therapy can be particularly appropriate in advanced or metastatic cancers. Treatment with the antibody therapy of the invention is indicated for patients who have received one or more rounds of chemotherapy.

Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637–4642, 1993), Prewett et al. (International J. of Onco. 9:217–224, 1996), and Hancock et al. (Cancer Res. 51:4575–4580, 1991) describe the use of various antibodies together with chemotherapeutic agents.

Although 184P1E2 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 184P1E2 expression, preferably using immunohistochemical assessments of tumor tissue, quantitative 184P1E2 imaging, or other techniques that reliably indicate the presence and degree of 184P1E2 expression. Immunohistochemical analysis of tumor biopsies or surgical specimens is preferred for this purpose. Methods for immunohistochemical analysis of tumor tissues are well known in the art.

Anti-184P1E2 monoclonal antibodies that treat prostate and other cancers include those that initiate a potent immune response against the tumor or those that are directly cytotoxic. In this regard, anti-184P1E2 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-184P1E2 mAbs that exert a direct biological effect on tumor growth are useful to treat cancers that express 184P1E2. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-184P1E2 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 184P1E2 antigen with high affinity but exhibit low or no antigenicity in the patient.

Therapeutic methods of the invention contemplate the administration of single anti-184P1E2 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-184P1E2 mAbs can be administered concomitantly with other therapeutic modalities, including but not limited to various chemotherapeutic agents, androgen-blockers, immune modulators (e.g., IL-2, GM-CSF), surgery or radiation. The anti-184P1E2 mAbs are administered in their "naked" or unconjugated form, or can have a therapeutic agent(s) conjugated to them.

Anti-184P1E2 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-184P1E2 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10–1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-184P1E2 mAb preparation represents an acceptable dosing regimen. Preferably, the initial loading dose is administered as a 90 minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 184P1E2 expression in the patient, the extent of circulating shed 184P1E2 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 184P1E2 in a given sample (e.g. the levels of circulating 184P1E2 antigen and/or 184P1E2 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-184P1E2 antibodies can also be used in anti-cancer therapy as a vaccine for inducing an immune response to cells expressing a 184P1E2-related protein. In particular, the generation of anti-idiotypic antibodies is well known in the art; this methodology can readily be adapted to generate anti-idiotypic anti-184P1E2 antibodies that mimic an epitope on a 184P1E2-related protein (see, for example, Wagner et al., 1997, Hybridoma 16: 33–40; Foon et al., 1995, J. Clin. Invest. 96:334–342; Herlyn et al., 1996, Cancer Immunol. Immunother. 43:65–76). Such an anti-idiotypic antibody can be used in cancer vaccine strategies.

X.C.) 184P1E2 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165: 539–547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 184P1E2 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3–4 epitopes that come from at least one tumor associated antigen (TAA). For HLA Class II a similar rationale is employed; again 3–4 epitopes are selected from at least one TAA (see, e.g., Rosenberg et al., Science 278:1447–1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915–3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 184P1E2, the PADRE® universal helper T cell epitope or multiple HTL epitopes from 184P1E2 (see e.g., Tables V–XVIII and XXII to LI), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30–100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., 1M for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830–843 (QYIKANSKFIGITE; SEQ. ID. NO: 29), *Plasmodium falciparum* circumsporozoite (CS) protein at positions 378–398 (DIEKKIAKMEKASSVFNVVNS; SEQ. ID. NO: 30), and *Streptococcus* 18 kD protein at positions 116–131 (GAVDSILGGVATYGAA; SEQ ID NO: 31). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID NO: 32), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε- and α-amino groups of a lysine residue and then linked, e.g., via one or more linking residues such as Gly, Gly—Gly-, Ser, Ser—Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser—Ser, to the amino terminus of the immunogenic peptide.

As another example of lipid priming of CTL responses, *E. coli* lipoproteins, such as tripalmitoyl-S-glycerylcysteinlyseryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to specifically prime an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 184P1E2. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 184P1E2.

X.D. Adoptive Immunotherapy

Antigenic 184P1E2-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7–28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 184P1E2. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 184P1E2. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 184P1E2-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 184P1E2, a vaccine comprising 184P1E2-specific CTL may be more efficacious in killing tumor cells in patient with advanced disease than alternative embodiments.

It is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μto about 50,000 μg per 70 kilogram patient. Boosting dosages of between about 1.0 μto about 50,000 μof peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$ Edition, A. Gennaro, Editor, Mack Publishing Co., Easton, Pa., 1985). For example a peptide dose for initial immunization can be from about 1 to about 50,000 µg, generally 100–5,000 µg, for a 70 kg patient. For example, for nucleic acids an initial immunization may be performed using an expression vector in the form of naked nucleic acid administered IM (or SC or ID) in the amounts of 0.5–5 mg at multiple sites. The nucleic acid (0.1 to 1000 µg) can also be administered using a gene gun. Following an incubation period of 3–4 weeks, a booster dose is then administered. The booster can be recombinant fowlpox virus administered at a dose of $5-10^7$ to $5 \times 10^9$ pfu.

For antibodies, a treatment generally involves repeated administration of the anti-184P1E2 antibody preparation, via an acceptable route of administration such as intravenous injection (IV), typically at a dose in the range of about 0.1 to about 10 mg/kg body weight. In general, doses in the range of 10–500 mg mAb per week are effective and well tolerated. Moreover, an initial loading dose of approximately 4 mg/kg patient body weight IV, followed by weekly doses of about 2 mg/kg IV of the anti-184P1E2 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 184P1E2 expression in the patient, the extent of circulating shed 184P1E2 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 µg–1 mg, 1 mg –50 mg, 50 mg–100 mg, 100 mg–200 mg, 200 mg–300 mg, 400 mg–500 mg, 500 mg–600 mg, 600 mg–700 mg, 700 mg–800 mg, 800 mg–900 mg, 900 mg–1 g, or 1 mg–700 mg. In certain embodiments, the dose is in a range of 2–5 mg/kg body weight, e.g., with follow on weekly doses of 1–3 mg/kg; 0.5 mg, 1, 2, 3, 4, 5, 6, 7, 8, 9, 10 mg/kg body weight followed, e.g., in two, three or four weeks by weekly doses; 0.5–10 mg/kg body weight, e.g., followed in two, three or four weeks by weekly doses; 225, 250, 275, 300, 325, 350, 375, 400 mg $m^2$ of body area weekly; 1–600 mg $m^2$ of body area weekly; 225–400 mg $m^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5\times10^{10}$ cells. A dose may also about $10^6$ cells/m² to about $10^{10}$ cells/m², or about $10^6$ cells/m² to about $10^8$ cells/m².

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al. *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10–95% of active ingredient, that is, one or more peptides of the invention, and more preferably at a concentration of 25%–75%.

For aerosol administration, immunogenic peptides are preferably supplied in finely divided form along with a surfactant and propellant. Typical percentages of peptides are about 0.01%–20% by weight, preferably about 1%–10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%–20% by weight of the composition, preferably about 0.25–5%. The balance of the composition is ordinarily propellant. A carrier can also be included, as desired, as with, e.g., lecithin for intranasal delivery.

XI.) Diagnostic and Prognostic Embodiments of 184P1E2.

As disclosed herein, 184P1E2 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of 184P1E2 in normal tissues, and patient specimens").

184P1E2 can be analogized to a prostate associated antigen PSA, the archetypal marker that has been used by medical practitioners for years to identify and monitor the presence of prostate cancer (see, e.g., Merrill et al., J. Urol. 163(2): 503–5120 (2000); Polascik et al., J. Urol. August; 162(2):293–306 (1999) and Fortier et al., J. Nat. Cancer Inst. 91(19): 1635–1640(1999)). A variety of other diagnostic markers are also used in similar contexts including p53 and K-ras (see, e.g., Tulchinsky et al., Int J Mol Med 1999 Jul. 4(1):99–102 and Minimoto et al., Cancer Detect Prev 2000; 24(1):1–12). Therefore, this disclosure of 184P1E2 polynucleotides and polypeptides (as well as 184P1E2 polynucleotide probes and anti-184P1E2 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 184P1E2 polynucleotides, polypeptides, reactive T cells and antibodies are analogous to those methods from well-established diagnostic assays which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567–74(1994)) and primers (for example in PCR analysis, see, e.g., Okegawa et al., J. Urol. 163(4): 1189–1190 (2000)) to observe the presence and/or the level of PSA mRNAs in methods of monitoring PSA overexpression or the metastasis of prostate cancers, the 184P1E2 polynucleotides described herein can be utilized in the same way to detect 184P1E2 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560–3 (2000)) or the metastasis of prostate cells (see, e.g., Alanen et al., Pathol. Res. Pract. 192(3):233–7 (1996)), the 184P1E2 polypeptides described herein can be utilized to generate antibodies for use in detecting 184P1E2 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 184P1E2 polynucleotides and/or polypeptides can be used to provide evidence of metastasis. For example, when a biological sample from tissue that does not normally contain 184P1E2-expressing cells (lymph node) is found to contain 184P1E2-expressing cells such as the 184P1E2 expression seen in LAPC4 and LAPC9, xenografts isolated from lymph node and bone metastasis, respectively, this finding is indicative of metastasis.

Alternatively 184P1E2 polynucleotides and/or polypeptides can be used to provide evidence of cancer, for example, when cells in a biological sample that do not normally express 184P1E2 or express 184P1E2 at a different level are found to express 184P1E2 or have an increased expression of 184P1E2 (see, e.g., the 184P1E2 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 184P1E2) such as PSA, PSCA etc. (see, e.g., Alanen et al., Pathol. Res. Pract. 192(3): 233–237 (1996)).

Just as PSA polynucleotide fragments and polynucleotide variants are employed by skilled artisans for use in methods of monitoring PSA, 184P1E2 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472–476, 478–480 (1998); Robertson et al., Methods Mol. Biol. 98:121–154 (1998)). An additional illustration of the use of such fragments is provided in the Example entitled "Expression analysis of 184P1E2 in normal tissues, and patient specimens," where a 184P1E2 polynucleotide fragment is used as a probe to show the expression of 184P1E2 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November–December 11(6): 407–13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a 184P1E2 polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 184P1E2 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 184P1E2 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 184P1E2 polypeptide shown in FIG. 3).

As shown herein, the 184P1E2 polynucleotides and polypeptides (as well as the 184P1E2 polynucleotide probes and anti-184P1E2 antibodies or T cells used to identify the presence of these molecules) exhibit specific properties that make them useful in diagnosing cancers such as those listed in Table I. Diagnostic assays that measure the presence of 184P1E2 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233–237 (1996)), and consequently, materials such as 184P1E2 polynucleotides and polypeptides (as well as the 184P1E2 polynucleotide probes and anti-184P1E2 antibodies used to identify the presence of these molecules) need to be employed to confirm a metastases of prostatic origin.

Finally, in addition to their use in diagnostic assays, the 184P1E2 polynucleotides disclosed herein have a number of other utilities such as their use in the identification of oncogenetic associated chromosomal abnormalities in the chromosomal region to which the 184P1E2 gene maps (see the Example entitled "Chromosomal Mapping of 184P1E2" below). Moreover, in addition to their use in diagnostic assays, the 184P1E2-related proteins and polynucleotides disclosed herein have other utilities such as their use in the forensic analysis of tissues of unknown origin (see, e.g., Takahama K Forensic Sci Int 1996 Jun. 28;80(1–2): 63–9).

Additionally, 184P1E2-related proteins or polynucleotides of the invention can be used to treat a pathologic condition characterized by the over-expression of 184P1E2. For example, the amino acid or nucleic acid sequence of FIG. 2 or FIG. 3, or fragments of either, can be used to generate an immune response to a 184P1E2 antigen. Antibodies or other molecules that react with 184P1E2 can be used to modulate the function of this molecule, and thereby provide a therapeutic benefit.

XII.) Inhibition of 184P1E2 Protein Function

The invention includes various methods and compositions for inhibiting the binding of 184P1E2 to its binding partner or its association with other protein(s) as well as methods for inhibiting 184P1E2 function.

XII.A.) Inhibition of 184P1E2 with Intracellular Antibodies

In one approach, a recombinant vector that encodes single chain antibodies that specifically bind to 184P1E2 are introduced into 184P1E2 expressing cells via gene transfer technologies. Accordingly, the encoded single chain anti-184P1E2 antibody is expressed intracellularly, binds to 184P1E2 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137–3141; Beerli et al, 1994, J. Biol. Chem. 289: 23931–23936; Deshane et al., 1994, Gene Ther. 1: 332–337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to precisely target the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 184P1E2 in the nucleus, thereby preventing its activity within the nucleus. Nuclear targeting signals are engineered into such 184P1E2 intrabodies in order to achieve the desired targeting. Such 184P1E2 intrabodies are designed to bind specifically to a particular 184P1E2 domain. In another embodiment, cytosolic intrabodies that specifically bind to a 184P1E2 protein are used to prevent 184P1E2 from gaining access to the nucleus, thereby preventing it from exerting any biological activity within the nucleus (e.g., preventing 184P1E2 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 184P1E2 with Recombinant Proteins

In another approach, recombinant molecules bind to 184P1E2 and thereby inhibit 184P1E2 function. For example, these recombinant molecules prevent or inhibit 184P1E2 from accessing/binding to its binding partner(s) or associating with other protein(s). Such recombinant molecules can, for example, contain the reactive part(s) of a 184P1E2 specific antibody molecule. In a particular embodiment, the 184P1E2 binding domain of a 184P1E2 binding partner is engineered into a dimeric fusion protein, whereby the fusion protein comprises two 184P1E2 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of 184P1E2, whereby the dimeric fusion protein specifically binds to 184P1E2 and blocks 184P1E2 interaction with a binding partner. Such dimeric fusion proteins are further combined into multimeric proteins using known antibody linking technologies.

XII.C.) Inhibition of 184P1E2 Transcription or Translation

The present invention also comprises various methods and compositions for inhibiting the transcription of the 184P1E2 gene. Similarly, the invention also provides methods and compositions for inhibiting the translation of 184P1E2 mRNA into protein.

In one approach, a method of inhibiting the transcription of the 184P1E2 gene comprises contacting the 184P1E2 gene with a 184P1E2 antisense polynucleotide. In another approach, a method of inhibiting 184P1E2 mRNA translation comprises contacting a 184P1E2 mRNA with an antisense polynucleotide. In another approach, a 184P1E2 specific ribozyme is used to cleave a 184P1E2 message, thereby inhibiting translation. Such antisense and ribozyme based methods can also be directed to the regulatory regions of the 184P1E2 gene, such as 184P1E2 promoter and/or enhancer elements. Similarly, proteins capable of inhibiting a 184P1E2 gene transcription factor are used to inhibit 184P1E2 mRNA transcription. The various polynucleotides and compositions useful in the aforementioned methods have been described above. The use of antisense and ribozyme molecules to inhibit transcription and translation is well known in the art Other factors that inhibit the transcription of 184P1E2 by interfering with 184P1E2 transcriptional activation are also useful to treat cancers expressing 184P1E2. Similarly, factors that interfere with 184P1E2 processing are useful to treat cancers that express 184P1E2. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 184P1E2 (i.e., antisense, ribozyme, polynucleotides encoding intrabodies and other 184P1E2 inhibitory molecules). A number of gene therapy approaches are known in the art. Recombinant vectors encoding 184P1E2 antisense polynucleotides, ribozymes, factors capable of interfering with 184P1E2 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 184P1E2 to a binding partner, etc.

In vivo, the effect of a 184P1E2 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402–408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences $16^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Kits

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a 184P1E2-related protein or a 184P1E2 gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequence of FIG. 2 or FIG. 3 or analogs thereof, or a nucleic acid molecules that encodes such amino acid sequences.

The kit of the invention will typically comprise the container described above and one or more other containers comprising materials desirable from a commercial and user standpoint, including buffers, diluents, filters, needles, syringes, and package inserts with instructions for use.

A label can be present on the container to indicate that the composition is used for a specific therapy or non-therapeutic application, and can also indicate directions for either in vivo or in vitro use, such as those described above. Directions and or other information can also be included on an insert which is included with the kit.

EXAMPLES

Various aspects of the invention are further described and illustrated by way of the several examples that follow, none of which are intended to limit the scope of the invention.

Example 1

SSH-Generated Isolation of a cDNA Fragment of the 184P1E2 Gene

To isolate genes that are over-expressed in bladder cancer, Suppression Subtractive Hybridization (SSH) procedure using cDNA derived from bladder cancer tissues, including invasive transitional cell carcinoma. The 184P1E2 SSH cDNA sequence was derived from a bladder cancer pool minus cDNAs derived normal bladder in addition to a pool of 9 normal tissues. The 184P1E2 cDNA was identified as highly expressed in the bladder cancer tissue pool, with no expression detected in normal tissues.

The SSH DNA sequence of 132 bp (FIG. 1) showed homology to peptidylarginine deiminase type III (AB026831) (FIG. 4A). 184P1E2 v.1 of 3183 bp was cloned from bladder cancer cDNA library, revealing an ORF of 664 amino acids (FIG. 2 and FIG. 3). The 184P1E2 v.1 protein is the same as the GenBank protein AB026831 with one amino acid difference at position 480 (FIG. 4B). Other variants of 184P1E2 were also identified, and these are listed in FIGS. 2 and 3. 184P1E2 v.3 is 100% identical to peptidylarginine deiminase type III Genbank protein AB026831 (see FIG. 4B and Table LIII).

Materials and Methods

Human Tissues:

The patient cancer and normal tissues were purchased from different sources such as the NDRI (Philadelphia, Pa.). mRNA for some normal tissues were purchased from Clontech, Palo Alto, Calif.

RNA Isolation:

Tissues were homogenized in Trizol reagent (Life Technologies, Gibco BRL) using 10 ml/g tissue isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

DPNCDN (cDNA Synthesis Primer):

5'TTTTGATCAAGCTT$_{30}$3'          (SEQ ID NO: 33)

Adaptor 1:

```
5'CTAATACGACTCACTATAGGGCTCGAGCGGCCGCCCGGGCAG3'   (SEQ ID NO: 34)

3'GGCCCGTCCTAG5'                                 (SEQ ID NO: 35)
```

Adaptor 2:

```
5'GTAATACGACTCACTATAGGGCAGCGTGGTCGCGGCCGAG3'   (SEQ ID NO: 36)

3'CGGCTCCTAG5'                                 (SEQ ID NO: 37)
```

PCR Primer 1:

```
5'CTAATACGACTCACTATAGGGC3'     (SEQ ID NO: 38)
```

Nested Primer (NP) 1:

```
5'TCGAGCGGCCGCCCGGGCAGGA3'     (SEQ ID NO: 39)
```

Nested Primer (NP)2:

```
5'AGCGTGGTCGCGGCCGAGGA3'       (SEQ ID NO: 40)
```

Suppression Subtractive Hybridization:

Suppression Subtractive Hybridization (SSH) was used to identify cDNAs corresponding to genes that may be differentially expressed in bladder cancer. The SSH reaction utilized cDNA from bladder cancer and normal tissues.

The gene 184P1E2 sequence was derived from a bladder cancer pool minus normal bladder cDNA subtraction. The SSH DNA sequence (FIG. 1) was identified.

The cDNA derived from of pool of normal tissues was used as the source of the "driver" cDNA, while the cDNA from a pool of bladder cancer tissues was used as the source of the "tester" cDNA. Double stranded cDNAs corresponding to tester and driver cDNAs were synthesized from 2 µg of poly(A)+ RNA isolated from the relevant xenograft tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT 1117-1, Catalog No. K1804-1). The resulting cDNA was digested with Dpn 11 for 3 hrs at 37° C. Digested cDNA was extracted with phenol/chloroform (1:1) and ethanol precipitated.

Driver cDNA was generated by combining in a 1:1 ratio Dpn II digested cDNA from the relevant tissue source (see above) with a mix of digested cDNAs derived from the nine normal tissues: stomach, skeletal muscle, lung, brain, liver, kidney, pancreas, small intestine, and heart.

Tester cDNA was generated by diluting 1 µl of Dpn II digested cDNA from the relevant tissue source (see above) (400 ng) in 5 µl of water. The diluted cDNA (2 µl, 160 ng) was then ligated to 2 µl of Adaptor 1 and Adaptor 2 (10 µM), in separate ligation reactions, in a total volume of 10 µl at 16° C. overnight, using 400 u of T4 DNA ligase (CLONTECH). Ligation was terminated with 1 µl of 0.2 M EDTA and heating at 72° C. for 5 min.

The first hybridization was performed by adding 1.5 µl (600 ng) of driver cDNA to each of two tubes containing 1.5 µl (20 ng) Adaptor 1- and Adaptor 2-ligated tester cDNA. In a final volume of 4 µl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 µl of fresh denatured driver cDNA and were allowed to hybridize overnight at 68° C. The second hybridization was then diluted in 200 µl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 µl of the diluted final hybridization mix was added to 1 µl of PCR primer 1 (10 µM), 0.5 µl dNTP mix (10 µM), 2.5 µl 10× reaction buffer (CLONTECH) and 0.5 µl 50× Advantage cDNA polymerase Mix (CLONTECH) in a final volume of 25 µl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 µl from the pooled and diluted primary PCR reaction was added to the same reaction mix as used for PCR 1, except that primers NP1 and NP2 (10 µM) were used instead of PCR primer 1. PCR 2 was performed using 10–12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed *E. coli* were subjected to blue/white and ampicillin selection. White colonies were picked and arrayed into 96 well plates and were grown in liquid culture overnight. To identify inserts, PCR amplification was performed on 1 ul of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 µg of mRNA with oligo (dT)12–18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 µl with water prior to normalization. First strand cDNAs from 16 different normal human tissues can be obtained from Clontech.

Normalization of the first strand cDNAs from multiple tissues was performed by using the primers 5' atatcgccgcgctcgtcgtcgacaa3' (SEQ ID NO: 41) and 5' agccacacgcagctcattgtagaagg 3' (SEQ ID NO: 42) to amplify β-actin. First strand cDNA (5 µl) were amplified in a total volume of 50 µl containing 0.4 µM primers, 0.2 µM each dNTPs, 1× PCR buffer (Clontech, 10 mM Tris-HCL, 1.5 mM MgCl$_2$, 50 mM KCl, pH8.3) and 1× Klentaq DNA polymerase (Clontech). Five µl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 b.p. β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 184P1E2 gene, 5 µl of normalized first strand cDNA were analyzed by PCR using 26, and 30 cycles of amplification. Semi-quantitative expression analysis can be achieved by comparing the PCR products at cycle numbers that give light band intensities. The primers used for RT-PCR were designed using the 184P1E2 SSH sequence and are listed below:

184P1E2.1

5'-AGTGACATGGAAGGAGATGAGTCC-3'    (SEQ ID NO: 43)

184P1E2.2

5'-ATACCTCCAGCTATGATGCCAAAC-3'    (SEQ ID NO: 44)

A typical RT-PCR expression analysis is shown in FIG. 14. First strand cDNA was prepared from vital pool 1 (liver, lung and kidney), vital pool 2 (pancreas, colon and stomach), bladder cancer pool, kidney cancer pool, lung cancer pool, and cancer metastasis pool. Normalization was performed by PCR using primers to actin and GAPDH. Semi-quantitative PCR, using primers to 184P1E2, was performed at 26 and 30 cycles of amplification. Results show strong expression of 184P1E2 in bladder cancer pool. Expression of 184P1E2 is also detected in kidney cancer pool, lung cancer pool and cancer metastasis pool, but not in vital pool 1 and vital pool 2.

Example 2

Full Length Cloning of 184P1E2

The 184P1E2 SSH cDNA sequence was derived from a bladder cancer pool minus normal bladder cDNA subtraction. The SSH cDNA sequence (FIG. 1) was designated 184P1E2.

The SSH DNA sequence of 132 bp (FIG. 1) showed homology to peptidylarginine deiminase type III (AB026831) (FIG. 4A). 184P1E2 v.1 of 3183 bp was cloned from bladder cancer cDNA library, revealing an ORF of 664 amino acids (FIG. 2 and FIG. 3). The 184P1E2 v.1 protein is the same as the GenBank protein AB026831 with one amino acid difference at position 480 (FIG. 4B). Other variants of 184P1E2 were also identified, and these are listed in FIGS. 2 and 3. 184P1E2 v.3 is 100% identical to peptidylarginine deiminase type III Genbank protein AB026831 (see FIG. 4B and Table LIII).

184P1E2 v.1 is 87% identical and 93% homologous to the mouse peptidylarginine deiminase type III protein. The amino acid alignment of these two proteins is shown in FIG. 4C.

Example 3

Chromosomal Mapping of 184P1E2

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Al.), human-rodent somatic cell hybrid panels such as is available from the Coriell Institute (Camden, N.J.), and genomic viewers utilizing BLAST homologies to sequenced and mapped genomic clones (NCBI, Bethesda, Md.).

184P1E2 maps to chromosome 1p36.13 using 184P1E2 sequence and the NCBI BLAST tool.

Example 4

Expression Analysis of 184P1E2 in Normal Tissues and Patient Specimens

Expression analysis by RT-PCR demonstrated that 184P1E2 is strongly expressed in bladder cancer patient specimens (FIG. 14). First strand cDNA was prepared from vital pool 1 (liver, lung and kidney), vital pool 2 (pancreas, colon and stomach), bladder cancer pool, kidney cancer pool, lung cancer pool, and cancer metastasis pool. Normalization was performed by PCR using primers to actin and GAPDH. Semi-quantitative PCR, using primers to 184P1E2, was performed at 26 and 30 cycles of amplification. Results show strong expression of 184P1E2 in bladder cancer pool. Expression of 184P1E2 is also detected in kidney cancer pool, lung cancer pool and cancer metastasis pool but not in vital pool 1 and vital pool 2.

Extensive northern blot analysis of 184P1E2 in multiple human normal tissues is shown in FIG. 15. No expression was detected in all 16 normal tissues tested.

Expression of 184P1E2 in bladder cancer patient specimens and human normal tissues is shown in FIG. 16. RNA was extracted from a pool of three bladder cancers, as well as from normal prostate NP), normal bladder (NB), normal kidney (N K), normal colon (NC), normal lung (NL) normal breast (NBr) and normal ovary (NO). Northern blot with 10 ug of total RNA/lane was probed with 184P1E2 sequence. The results show expression of an approximately 4.5 kb 184P1E2 transcript in the bladder cancer pool but not in the normal tissues tested. Analysis of individual patient specimens is shown in FIG. 17. RNA was extracted from normal bladder NB), bladder cancer cell lines (CL; UM-UC-3, J82 and SCaBER), bladder cancer patient tumors (T) and normal tissue adjacent to bladder cancer (N). Northern blots with 10 ug of total RNA were probed with the 184P1E2 sequence. Size standards in kilobases are indicated on the side. Results show strong expression of 184P E2 in the bladder tumor tissues but not in normal bladder, nor in the bladder cancer cell lines.

FIG. 18 shows that 184P1E2 was expressed in lung cancer patient tissues. RNA was extracted from normal lung (N), lung cancer cell lines (CALU-1, A427, NCI-H82, NCI-146) (all referred to as "CL"), lung cancer patient tumors (T) and their normal adjacent tissues (Nat). Northern blots with 10 ug of total RNA were probed with the 184P1E2 sequence. Results show strong expression of 184P1E2 in the lung cancer patient tissues, but not in normal lung. A lower molecular weight transcript of approximately 2.0 kb was also detected in the two lung cancer cell lines CALU-1 and NCI-H146.

The restricted expression of 184P1E2 in normal tissues and the expression detected in bladder cancer, lung cancer, kidney cancer, and cancer metastases suggest that 184P1E2 is a potential therapeutic target and a diagnostic marker for human cancers.

Example 5

Transcript Variants of 184P1E2

Transcript variants are variants of matured mRNA from the same gene by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or may encode proteins with different functions, and may be expressed in the same tissue at the same time, or at different tissue, or at different times, proteins encoded by transcript variants can have similar or different cellular or extracellular localizations, i.e., be secreted.

Transcript variants are identified by a variety of art-accepted methods. For example, alternative transcripts and splice variants are identified in a full-length cloning experiment, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April; 10(4):516–22); Grail; and GenScan). For a general discussion of splice variant identification protocols see., e.g., Southan, C., A genomic perspective on human proteases, FEBS Lett. 2001 Jun. 8; 498(2–3):214–8; de Souza, S. J., et al., Identification of human chromosome 22 transcribed sequences with ORF expressed sequence tags, Proc. Natl. Acad Sci USA. 2000 Nov. 7; 97(23): 12690–3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1–2):321–6; Ferranti P, et al., Differential splicing of pre-messenger RNA produces multiple forms of mature caprine alpha(s1)-casein, Eur J Biochem. 1997 Oct. 1; 249(1): 1–7. For PCR-based Validation: Wellmann S, et al., Specific reverse transcription-PCR quantification of vascular endothelial growth factor (VEGF) splice variants by LightCycler technology, Clin Chem. 2001 April; 47(4): 654–60; Jia, H. P., et al., Discovery of new human beta-defensins using a genomics-based approach, Gene. 2001 Jan 24; 263(1–2):211–8. For PCR-based and 5' RACE Validation: Brigle, K. E., et al., Organization of the murine reduced folate carrier gene and identification of variant splice forms, Biochem Biophys Acta. 1997 Aug. 7; 1353(2):191–8).

It is known in the art that genomic regions are modulated in cancers. When the genomic region, to which a gene maps, is modulated in a particular cancer, the alternative transcripts or splice variants of the gene are modulated as well. Disclosed herein is that 184P1E2 has a particular expression profile related to cancer. Alternative transcripts and splice variants of 184P1E2 may also be involved in cancers in the same or different tissues, thus serving as tumor-associated markers/antigens.

The exon composition of the original transcript, designated as 184P1E2 v. 1, is shown in FIG. 12.

Example 6

Single Nucleotide Polymorphisms of 184P1E2

A Single Nucleotide Polymorphism (SNP) is a single base pair variation in nucleotide sequences. At a specific point of the genome, there are four possible nucleotide base pairs: A/T, C/G, G/C and T/A. Genotype refers to the base pair make-up of one or more spots in the genome of an individual, while haplotype refers to base pair make-up of more than one varied spots on the same DNA molecule (chromosome in higher organism). SNPs that occur on a cDNA are called cSNPs. These cSNPs may change amino acids of the protein encoded by the gene and thus change the functions of the protein. Some SNPs cause inherited diseases and some others contribute to quantitative variations in phenotype and reactions to environmental factors including diet and drugs among individuals. Therefore, SNPs and/or combinations of alleles (called haplotypes) have many applications including diagnosis of inherited diseases, determination of drug reactions and dosage, identification of genes responsible for disearses and discovery of genetic relationship between individuals (P. Nowotny, J. M. Kwon and A. M. Goate, "SNP analysis to dissect human traits," Curr. Opin. Neurobiol. 2001 October; 11(5):637–641; M. Pirmohamed and B. K. Park, "Genetic susceptibility to adverse drug reactions," Trends Pharmacol. Sci. 2001 June; 22(6): 298–305; J. H. Riley, C. J. Allan, E. Lai and A. Roses, "The use of single nucleotide polymorphisms in the isolation of common disease genes," Pharmacogenomics. 2000 February; 1(1):39–47; R. Judson, J. C. Stephens and A. Windemuth, "The predictive power of haplotypes in clinical response," Pharmacogenomics. 2000 February; 1(1): 15–26).

SNPs are identified by a variety of art-accepted methods (P. Bean, "The promising voyage of SNP target discovery," Am. Clin. Lab. 2001 October–November; 20(9):18–20; K. M. Weiss, "In search of human variation," Genome Res. 1998 July; 8(7):691–697; M. M. She, "Enabling large-scale pharmacogenetic studies by high-throughput mutation detection and genotyping technologies," Clin. Chem. 2001 February; 47(2):164–172). For example, SNPs are identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled front different individuals or by comparing sequences from different DNA samples. With the rapid accumulation of sequence data in public and private databases, one can discover SNPs by comparing sequences using computer programs (Z. Gu, L. Hillier and P. Y. Kwok, "Single nucleotide polymorphism hunting in cyberspace," Hum. Mutat. 1998; 12(4):221–225). SNPs can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235–258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329–340).

Using the methods described above, nine SNPs were identified in the transcript, 184P1E2 v. 1, at positions 951 (C/G), 1480 (C/T), 1910 (T/G), 2468 (C/T), 2623 (T/G), 2742 (G/T), 2924 (A/C), 3060 (C/A) and 356 (G/A). The transcripts with alternative alleles were designated as variants 184P1E2 v.2, v.3, v.4, v.5, v.6, v.7, v.8, v.9, and v.10, respectively. FIG. 10 shows the schematic alignment of the nucleotide variants. FIG. II shows the schematic alignment of protein variants, corresponding to nucleotide variants. Nucleotide variants that code for the same amino acid sequence as variant 1 are not shown in FIG. 11. These alleles of the SNPs, though shown separately here, can occur in different combinations (haplotypes) and in any other transcript variants that contains the sequence context of the SNPs.

Example 7

Production of Recombinant 184P1E2 in Prokaryotic Systems

To express recombinant 184P1E2 and 184P1E2 variants in prokaryotic cells, the full or partial length 184P1E2 and 184P1E2 variant cDNA sequences are cloned into any one of a variety of expression vectors known in the art. One or more of the following regions of 184P1E2 amino acids 1–664; or any 8, 9, 10, 11, 12, 13, 14, 15, 16, 17, 18, 19, 20, 21, 22, 23, 24, 25, 26, 27, 28, 29, 30 or more contiguous amino acids from 184P1E2, variants, or analogs thereof.

A. In Vitro Transcription and Translation Constructs:

pCRII: To generate 184P1E2 sense and anti-sense RNA probes for RNA in situ investigations, pCRII constructs (Invitrogen, Carlsbad Calif.) are generated encoding either all or fragments of the 184P1E2 cDNA. The pCRII vector has Sp6 and T7 promoters flanking the insert to drive the transcription of 184P1E2 RNA for use as probes in RNA in situ hybridization experiments. These probes are used to analyze the cell and tissue expression of 184P1E2 at the RNA level. Transcribed 184P1E2 RNA representing the cDNA amino acid coding region of the 184P1E2 gene is used in in vitro translation systems such as the TnT™ Coupled Reticulolysate System (Promega, Corp., Madison, Wis.) to synthesize 184P1E2 protein.

B. Bacterial Constructs:

pGEX Constructs: To generate recombinant 184P1E2 proteins in bacteria that are fused to the Glutathione S-transferase (GST) protein, all or parts of the T-fusion vector of the pGEX family (Amersham Pharmacia Biotech, Piscataway, N.J.). These constructs allow controlled expression of recombinant 184P1E2 protein sequences with GST fused at the amino-terminus and a six histidine epitope (6X His) at the carboxyl-terminus. The GST and 6X His tags permit purification of the recombinant fusion protein from induced bacteria with the appropriate affinity matrix and allow recognition of the fusion protein with anti-GST and anti-His antibodies. The 6X His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 184P1E2-related protein. The ampicillin resistance gene and pBR322 origin permits selection and maintenance of the pGEX plasmids in E. coli.

pMAL Constructs: To generate, in bacteria, recombinant 184P1E2 proteins that are fused to maltose-binding protein (MBP), all or parts of the 184P1E2 cDNA protein coding sequence are fused to the MBP gene by cloning into the pMAL-c2X and pMAL-p2X vectors (New England Biolabs, Beverly, Mass.). These constructs allow controlled expression of recombinant 184P1E2 protein sequences with MBP fused at the amino-terminus and a 6X His epitope tag at the carboxyl-terminus. The MBP and 6X His tags permit purification of the recombinant protein from induced bacteria with the appropriate affinity matrix and allow recognition of the fusion protein with anti-MBP and anti-His antibodies. The 6X His epitope tag is generated by adding 6 histidine codons to the 3' cloning primer. A Factor Xa recognition site permits cleavage of the pMAL tag from 184P1E2. The pMAL-c2X and pMAL-p2X vectors are optimized to express the recombinant protein in the cytoplasm or periplasm respectively. Periplasm expression enhances folding of proteins with disulfide bonds.

pET Constructs: To express 184P1E2 in bacterial cells, all or parts of the 184P1E2 cDNA protein coding sequence are cloned into the pET family of vectors (Novagen, Madison, Wis.). These vectors allow tightly controlled expression of recombinant 184P1E2 protein in bacteria with and without fusion to proteins that enhance solubility, such as NusA and thioredoxin (Trx), and epitope tags, such as 6X His and S-Tag™ that aid purification and detection of the recombinant protein. For example, constructs are made utilizing pET NusA fusion system 43.1 such that regions of the 184P1E2 protein are expressed as amino-terminal fusions to NusA.

C. Yeast Constructs:

pESC Constructs: To express 184P1E2 in the yeast species Saccharomyces cerevisiae for generation of recombinant protein and functional studies, all or parts of the 184P1E2 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein—protein interactions of 184P1E2. In addition, expression in yeast yields similar post-translational modifications, such as glycosylations and phosphorylations, that are found when expressed in eukaryotic cells.

pESP Constructs: To express 184P1E2 in the yeast species *Saccharomyces pombe*, all or parts of the 184P1E2 cDNA protein coding sequence are cloned into the pESP family of vectors. These vectors allow controlled high level of expression of a 184P1E2 protein sequence that is fused at either the amino terminus or at the carboxyl terminus to GST which aids purification of the recombinant protein. A Flag™ epitope tag allows detection of the recombinant protein with anti-Flag™ antibody.

Example 8

Production of Recombinant 184P1E2 in Eukaryotic Systems

A. Mammalian Constructs:

To express recombinant 184P1E2 in eukaryotic cells, the full or partial length 184P1E2 cDNA sequences can be cloned into any one of a variety of expression vectors known in the art. One or more of the following regions of 184P1E2 are expressed in these constructs, amino acids 1 to 664, or any 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous amino acids from 184P1E2, variants, or analogs thereof. In certain embodiments a region of a specific variant of 184P1E2 is expressed that encodes an amino acid at a specific position which differs from the amino acid of any other variant found at that position. In other embodiments, a region of a variant of 184P1E2 is expressed that lies partly or entirely within a sequence that is unique to that variant.

The constructs can be transfected into any one of a wide variety of mammalian cells such as 293T cells. Transfected 293T cell lysates can be probed with the anti-184P1E2 polyclonal serum, described herein.

pcDNA4/HisMax Constructs: To express 184P1E2 in mammalian cells, a 184P1E2 ORF, or portions thereof, of 184P1E2 are cloned into pcDNA4/HisMax Version A (Invitrogen, Carlsbad, Calif.). Protein expression is driven from the cytomegalovirus (CMV) promoter and the SP 16 translational enhancer. The recombinant protein has Xpress™ and six histidine (6X His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli*.

pcDNA3.1/MycHis Constructs: To express 184P1E2 in mammalian cells, a 184P1E2 ORF, or portions thereof, of 184P1E2 with a consensus Kozak translation initiation site are cloned into pcDNA3.1/MycHis Version A (Invitrogen, Carlsbad, Calif.). Protein expression is driven from the cytomegalovirus (CMV) promoter. The recombinant proteins have the myc epitope and 6X His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli*.

pcDNA3.1/CT-GFP-TOPO Construct: To express 184P1E2 in mammalian cells and to allow detection of the recombinant proteins using fluorescence, a 184P1E2 ORF, or portions thereof, with a consensus Kozak translation initiation site are cloned into pcDNA3.1/CT-GFP-TOPO (Invitrogen, Calif.). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli*. Additional constructs with an amino-terminal GFP fusion are made in pcDNA3.1/NT-GFP-TOPO spanning the entire length of a 184P1E2 protein.

PAPtag: A 184P1E2 ORF, or portions thereof, is cloned into pAPtag-5 (GenHunter Corp. Nashville, Tenn.). This construct generates an alkaline phosphatase fusion at the carboxyl-terminus of a 184P1E2 protein while fusing the IgGκ signal sequence to the amino-terminus. Constructs are also generated in which alkaline phosphatase with an amino-terminal IgGκ signal sequence is fused to the amino-terminus of a 184P1E2 protein. The resulting recombinant 184P1E2 proteins are optimized for secretion into the media of transfected mammalian cells and can be used to identify proteins such as ligands or receptors that interact with 184P1E2 proteins. Protein expression is driven from the CMV promoter and the recombinant proteins also contain myc and 6X His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E. coli*.

Ptag5: A 184P1E2 ORF, or portions thereof, is cloned into pTag-5. This vector is similar to pAPtag but without the alkaline phosphatase fusion. This construct generates 184P1E2 protein with an amino-terminal IgGκ signal sequence and myc and 6X His epitope tags at the carboxyl-terminus that facilitate detection and affinity purification. The resulting recombinant 184P1E2 protein is optimized for secretion into the media of transfected mammalian cells, and is used as immunogen or ligand to identify proteins such as ligands or receptors that interact with the 184P1E2 proteins. Protein expression is driven from the CMV promoter. The Zeocin resistance gene present in the vector allows for selection of mammalian cells expressing the protein, and the ampicillin resistance gene permits selection of the plasmid in *E. coli*.

PsecFc: A 184P1E2 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, Calif.). This construct generates an IgG1 Fc fusion at the carboxyl-terminus of the 184P1E2 proteins, while fusing the IgGκ signal sequence to N-terminus. 184P1E2 fusions utilizing the murine IgG1 Fc region are also used. The resulting recombinant 184P1E2 proteins are optimized for secretion into the media of transfected mammalian cells, and can be used as immunogens or to identify proteins such as ligands or receptors that interact with 184P1E2 protein. Protein expression is driven from the CMV promoter. The hygromycin resistance gene present in the vector allows for selection of mammalian cells that express the recombinant protein, and the ampicillin resistance gene permits selection of the plasmid in E. coli.

pSRα Constructs: To generate mammalian cell lines that express 184P1E2 constitutively, 184P1E2 ORF, or portions thereof, of 184P1E2 are cloned into pSRα constructs. Amphotropic and ecotropic retroviruses are generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 184P1E2, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in E. coli. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 184P1E2 sequences to allow detection using anti-Flag antibodies. For example, the FLAG™ sequence 5' gat tac aag gat gac gac gat aag 3' (SEQ ID NO: 45) is added to cloning primer at the 3' end of the ORF. Additional pSRα constructs are made to produce both amino-terminal and carboxyl-terminal GFP and myc/6X His fusion proteins of the full-length 184P1E2 proteins.

Additional Viral Vectors: Additional constructs are made for viral-mediated delivery and expression of 184P1E2. High virus titer leading to high level expression of 184P1E2 is achieved in viral delivery systems such as adenoviral vectors and herpes amplicon vectors. A 184P1E2 coding sequences or fragments thereof are amplified by PCR and subcloned into the AdEasy shuttle vector (Stratagene). Recombination and virus packaging are performed according to the manufacturer's instructions to generate adenoviral vectors. Alternatively, 184P1E2 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 184P1E2 in mammalian cells, coding sequences of 184P1E2, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 184P1E2. These vectors are thereafter used to control expression of 184P1E2 in various cell lines such as PC3, NIH 3T3, 293 or rat-1 cells.

B. Baculovirus Expression Systems

To generate recombinant 184P1E2 proteins in a baculovirus expression system, 184P1E2 ORF, or portions thereof, are cloned into the baculovirus transfer vector pBlueBac 4.5 (Invitrogen), which provides a His-tag at the N-terminus. Specifically, pBlueBac-184P1E2 is co-transfected with helper plasmid pBac-N-Blue (Invitrogen) into SF9 (Spodoptera frugiperda) insect cells to generate recombinant baculovirus (see Invitrogen instruction manual for details). Baculovirus is then collected from cell supernatant and purified by plaque assay.

Recombinant 184P1E2 protein is then generated by infection of HighFive insect cells (Invitrogen) with purified baculovirus. Recombinant 184P1E2 protein can be detected using anti-184P1E2 or anti-His-tag antibody. 184P1E2 protein can be purified and used in various cell-based assays or as immunogen to generate polyclonal and monoclonal antibodies specific for 184P1E2.

Example 9

Antigenicity Profiles and Secondary Structure

FIG. 5, FIG. 6, FIG. 7, FIG. 8, and FIG. 9 depict graphically five amino acid profiles of the 184P1E2 variants 1 through 4 respectively, each assessment available by accessing the ProtScale website on the ExPasy molecular biology server.

These profiles: FIG. 5, Hydrophilicity, (Hopp T. P., Woods K. R., 1981. Proc. Natl. Acad. Sci. U.S.A. 78:3824–3828); FIG. 6, Hydropathicity, (Kyte J., Doolittle R. F., 1982. J. Mol. Biol. 157:105–132); FIG. 7, Percentage Accessible Residues (Janin J., 1979 Nature 277:491–492); FIG. 8, Average Flexibility, (Bhaskaran R., and Ponnuswamy P. K., 1988. Int. J. Pept. Protein Res. 32:242–255); FIG. 9, Beta-turn (Deleage, G., Roux B. 1987 Protein Engineering 1:289–294); and optionally others available in the art, such as on the ProtScale website, were used to identify antigenic regions of the 184P1E2 protein. Each of the above amino acid profiles of 184P1E2 were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the 184P1E2 protein and of the variant proteins indicated, e.g., by the profiles set forth in FIG. 5, FIG. 6, FIG. 7, FIG. 8, and/or FIG. 9 are used to prepare immunogens, either peptides or nucleic acids that encode them, to generate therapeutic and diagnostic anti-184P1E2 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 184P1E2 protein variants listed in FIGS. 2 and 3. In particular, peptide immunogens of the invention can comprise, a peptide region of at least 5 amino acids of FIGS. 2 and 3 in any whole number increment that includes an amino acid position having a value greater than 0.5 in the Hydrophilicity profile of FIG. 5; a peptide region of at least 5 amino acids of FIGS. 2 and 3 in any whole number increment that includes an amino acid position having a value less than 0.5 in the Hydropathicity profile of FIG. 6; a peptide region of at least 5 amino acids of FIGS. 2 and 3 in any whole number increment that includes an amino acid position having a value greater than 0.5 in the Percent Accessible Residues profile of FIG. 7; a peptide region of at least 5 amino acids of FIGS. 2 and 3 in any whole number increment that includes an amino acid position having a value greater than 0.5 in the Average Flexibility profile on FIG. 8; and, a peptide region of at least 5 amino acids of FIGS. 2 and 3 in any whole number increment that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 184P1E2 variant 1, namely the predicted presence and location of alpha helices, extended strands, and random coils, is predicted from the primary amino acid sequence using the HNN—Hierarchical Neural Network method (Guermeur, 1997), accessed from the ExPasy molecular biology server. The analysis indicates that 184P1E2 variant 1 is composed of 25.30% alpha helix, 22.59% extended strand, and 52.11% random coil (FIG. 13).

Analysis for the potential presence of transmembrane domains in 184P1E2 variant 1 was carried out using a variety of transmembrane prediction algorithms accessed from the ExPasy molecular biology server. The programs do not predict the presence of transmembrane domains in 184P1E2, suggesting that it is a soluble protein.

Example 10

Generation of 184P1E2 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with the full length 184P1E2 protein, computer algorithms are employed in design of immunogens that, based on amino acid sequence analysis contain characteristics of being antigenic and available for recognition by the immune system of the immunized host (see the Example entitled "Antigenicity Profiles"). Such regions would be predicted to be hydrophilic, flexible, in beta-turn conformations, and be exposed on the surface of the protein (see, e.g., FIG. 5, FIG. 6, FIG. 7, FIG. 8, or FIG. 9 for amino acid profiles that indicate such regions of 184P1E2 and variants).

For example, 184P1E2 recombinant bacterial fusion proteins or peptides containing hydrophilic, flexible, beta-turn regions of 184P1E2 variant proteins are used as antigens to generate polyclonal antibodies in New Zealand White rabbits. For example, such regions include, but are not limited to, amino acids 53–73, amino acids, amino acids 117–136, amino acids 217–251, and 366–446 of 184P1E2 variant 1. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 53–73 of 184P1E2 variant 1 is conjugated to KLH and used to immunize the rabbit. Alternatively the immunizing agent may include all or portions of the 184P1E2 variant proteins, analogs or fusion proteins thereof. For example, the 184P1E2 variant 1 amino acid sequence can be fused using recombinant DNA techniques to any one of a variety of fusion protein partners that are well known in the art, such as glutathione-S-transferase (GST) and HIS tagged fusion proteins. Such fusion proteins are purified from induced bacteria using the appropriate affinity matrix.

In one embodiment, a GST-fusion protein encoding amino acids 1–251, encompassing several predicted antigenic regions, is produced and purified and used as immunogen. Other recombinant bacterial fusion proteins that may be employed include maltose binding protein, LacZ, thioredoxin, NusA, or an immunoglobulin constant region (see the section entitled "Production of 184P1E2 in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Darnle, N., and Ledbetter, L.(1991) J. Exp. Med. 174, 561–566).

In addition to bacterial derived fusion proteins, mammalian expressed protein antigens are also used. These antigens are expressed from mammalian expression vectors such as the Tag5 and Fc-fusion vectors (see the Example entitled "Production of Recombinant 184P1E2 in Eukaryotic Systems"), and retain post-translational modifications such as glycosylations found in native protein. In one embodiment, the full length sequence of variant 1, amino acids 1–664, is cloned into the Tag5 mammalian secretion vector. The recombinant protein is purified by metal chelate chromatography from tissue culture supernatants of 293T cells stably expressing the recombinant vector. The purified Tag5 184P1E2 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 μg, typically 100–200 μg, of fusion protein or peptide conjugated to KLH mixed in complete Freund's adjuvant (CFA). Rabbits are then injected subcutaneously every two weeks with up to 200 μg, typically 100–200 μg, of the immunogen in incomplete Freund's adjuvant (IFA). Test bleeds are taken approximately 7–10 days following each immunization and used to monitor the titer of the antiserum by ELISA.

To test reactivity and specificity of immune serum, such as the rabbit serum derived from immunization with a KLH-conjugated peptide encoding amino acids 53–73 of variant 1, the full-length 184P1E2 variant 1 cDNA is cloned into pcDNA 3.1 myc-his expression vector (Invitrogen, see the Example entitled "Production of Recombinant 184P1E2 in Eukaryotic Systems"). After transfection of the constructs into 293T cells, cell lysates are probed with the anti-184P1E2 serum and with anti-His antibody (Santa Cruz Biotechnologies, Santa Cruz, Calif.) to determine specific reactivity to denatured 184P1E2 protein using the Western blot technique. The immune serum is then tested by the Western blot technique against 293T-184P1E2 cells. In addition, the immune serum is tested by fluorescence microscopy, flow cytometry and immunoprecipitation against 293T and other recombinant 184P1E2-expressing cells to determine specific recognition of native protein. Western blot, immunoprecipitation, fluorescent microscopy, and flow cytometric techniques using cells that endogenously express 184P1E2 are also carried out to test reactivity and specificity.

Anti-serum from rabbits immunized with 184P1E2 variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-184P1E2 fusion protein encoding amino acids 1–251 is first purified by passage over a column of GST protein covalently coupled to AffiGel matrix (BioRad, Hercules, Calif.). The antiserum is then affinity purified by passage over a column composed of a MBP-fusion protein also encoding amino acids 1–251 covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of 184P1E2 Monoclonal Antibodies (mAbs)

In one embodiment, therapeutic mAbs to 184P1E2 variants comprise those that react with epitopes specific for each variant protein or specific to sequences in common between the variants that would disrupt or modulate the biological function of the 184P1E2 variants, for example those that would disrupt the interaction with ligands and substrates or disrupt its catalytic activity. Immunogens for generation of such mAbs include those designed to encode or contain the entire 184P1E2 protein variant sequence, regions of the 184P1E2 protein variants predicted to be antigenic from computer analysis of the amino acid sequence (see, e.g., FIG. 5, FIG. 6, FIG. 7, FIG. 8, or FIG. 9, and the Example entitled "Antigenicity Profiles"). Immunogens include peptides, recombinant bacterial proteins, and mammalian expressed Tag 5 proteins and human and murine IgG FC fusion proteins. In addition, cells engineered to express high levels of a respective 184P1E2 variant, such as 293T-184P1E2 variant 1 or 300.19–184P1E2 variant 1 murine Pre-B cells, are used to immunize mice.

To generate mAbs to a 184P1E2 variant, mice are first immunized intraperitoneally (IP) with, typically, 10–50 μg of protein immunogen or $10^7$ 184P1E2-expressing cells mixed in complete Freund's adjuvant. Mice are then subsequently immunized IP every 2–4 weeks with, typically, 10–50 μg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a 184P1E2 variant sequence is used to immunize mice by direct injection of the plasmid DNA. For example, the full length variant 1 sequence, encoding amino acids 1–664, is cloned into the Tag5 mammalian secretion vector and the recombinant vector is used as immunogen. In another example the same amino acids are cloned into an Fc-fusion secretion vector in which the 184P1E2 variant 1 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective 184P1E2 variant.

During the immunization protocol, test bleeds are taken 7–10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 184P1E2 monoclonal antibodies, a Tag5–184P1E2 variant 1 antigen encoding amino acids 1–664, is expressed and purified from stably transfected 293T cells. Balb C mice are initially immunized intraperitoneally with 25 μg of the Tag5–184P1E2 variant 1 protein mixed in complete Freund's adjuvant. Mice are subsequently immunized every two weeks with 25 μg of the antigen mixed in incomplete Freund's adjuvant for a total of three immunizations. ELISA using the Tag5 antigen determines the titer of serum from immunized mice. Reactivity and specificity of serum to full length 184P1E2 variant protein is monitored by Western blotting, immunoprecipitation and flow cytometry using 293T cells transfected with an expression vector encoding the 184P1E2 variant 1 cDNA (see e.g., the Example entitled "Production of Recombinant 184P1E2 in Eukaryotic Systems"). Other recombinant 184P1E2 variant 1-expressing cells or cells endogenously expressing 184P1E2 variant 1 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify 184P1E2 specific antibody-producing clones.

The binding affinity of a 184P1E2 monoclonal antibody is determined using standard technologies. Affinity measurements quantify the strength of antibody to epitope binding and are used to help define which 184P1E2 monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Sette, et al. *Mol. Immunol.* 31:813 (1994)). Briefly, purified MHC molecules (5 to 500 nM) are incubated with various unlabeled peptide inhibitors and 1–10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10–20% of the total radioactivity. All subsequent inhibition and direct binding assays are performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotif or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes.

The searches performed to identify the motif-bearing peptide sequences in the Example entitled "Antigenicity Profiles" and Tables V–XVIII and XXII–LI employ the protein sequence data from the gene product of 184P1E2 set forth in FIGS. 2 and 3, the specific peptides used to generate the tables are listed in table LII.

Computer searches for epitopes bearing HLA Class I or Class II supermotifs or motifs are performed as follows. All translated 184P1E2 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$"\Delta G" = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258–126, 1997; (see also Sidney et al., *Human Immunol.* 45:79–93, 1996; and Southwood et al., *J. Immunol.* 160:3363–3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from 184P1E2 are scanned utilizing motif identification software, to identify 8-, 9–10- and and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 184P1E2 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 184P1E2 protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 184P1E2 protein can also be performed to identify HLA-A 1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The .221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 µg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® 450) and the detacha-bead® reagent. Typically about $200-250\times10^6$ PBMC are processed to obtain $24\times10^6$ CD8+ T-cells (enough for a 48-well plate culture). Briefly, the PBMCs are thawed in RPMI with 30 µg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 µl beads/$20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 µl/ml detacha-bead® reagent and 30 µg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5–7 minutes, washed once with PBS with 1% BSA, counted and pulsed with 40 µg/ml of peptide at a cell concentration of $1-2\times10^6$/ml in the presence of 3 µg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 µg/ml of peptide in the presence of 3 µg/ml $\beta_2$ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2–3 days later at 50 IU/ml (Tsai et al.; *Critical Reviews in Immunology* 18(1–2):65–75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 µg/ml peptide overnight at 37° C.

Adherent target cells are removed from culture flasks with trypsin-EDTA. Target cells are labeled with 200 µCi of $^{51}$Cr sodium chromate (Dupont, Wilmington, Del.) for 1 hour at 37° C. Labeled target cells are resuspended at $10^6$ per ml and diluted 1:10 with K562 cells at a concentration of $3.3\times10^6$/ml (an NK-sensitive erythroblastoma cell line used to reduce non-specific lysis). Target cells (100 µl) and effectors (100 µl) are plated in 96 well round-bottom plates and incubated for 5 hours at 37° C. At that time, 100 µl of supernatant are collected from each well and percent lysis is determined according to the formula:

[(cpm of the test sample–cpm of the spontaneous $^{51}$Cr release sample)/(cpm of the maximal $^{51}$Cr release sample–cpm of the spontaneous $^{51}$Cr release sample)]×100.

Maximum and spontaneous release are determined by incubating the labeled targets with 1% Triton X-100 and media alone, respectively. A positive culture is defined as one in which the specific lysis (sample—background) is 10% or higher in the case of individual wells and is 15% or more at the two highest E:T ratios when expanded cultures are assayed.

In situ Measurement of Human IFNγ Production as an Indicator of Peptide-Specific and Endogenous Recognition Immulon 2 plates are coated with mouse anti-human IFNγ monoclonal antibody (4 µg/ml 0.1M NaHCO$_3$, pH8.2) overnight at 4° C. The plates are washed with Ca$^{2+}$, Mg$^{2+}$-free PBS/0.05% Tween 20 and blocked with PBS/10% FCS for two hours, after which the CTLs (100 µl/well) and targets (100 µl/well) are added to each well, leaving empty wells for the standards and blanks (which received media only). The target cells, either peptide-pulsed or endogenous targets, are used at a concentration of 1×10$^6$ cells/ml. The plates are incubated for 48 hours at 37° C. with 5% CO$_2$.

Recombinant human IFN-gamma is added to the standard wells starting at 400 pg or 1200 pg/100 microliter/well and the plate incubated for two hours at 37° C. The plates are washed and 100 µl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5–15 minutes. The reaction is stopped with 50 microliter/well 1M H$_3$PO$_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, 5×10$^4$ CD8+ cells are added to a T25 flask containing the following: 1×10$^6$ irradiated (4,200 rad) PBMC (autologous or allogeneic) per ml, 2×10$^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 µM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds 1×10$^6$/ml and the cultures are assayed between days 13 and 15 at E:T ratios of 30, 10, 3 and 1:1 in the $^{51}$Cr release assay or at 1×10$^6$/ml in the in situ IFNγ assay using the same targets as before the expansion.

Cultures are expanded in the absence of anti-CD3$^+$ as follows. Those cultures that demonstrate specific lytic activity against peptide and endogenous targets are selected and 5×10$^4$ CD8$^+$ cells are added to a T25 flask containing the following: 1×10$^6$ autologous PBMC per ml which have been peptide-pulsed with 10 µg/mil peptide for two hours at 37° C. and irradiated (4,200 rad); 2×10$^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 184P1E2. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an IC$_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to ⅗ of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (J. Immunol. 157:3480–3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 184P1E2-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 184P1E2-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 184P1E2-derived, HLA class II HTL epitopes, a 184P1E2 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., J. Immunol. 160: 3363–3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 184P1E2-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 184P1E2-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 184P1E2 antigens are analyzed for sequences carrying one of the two DR3-specific binding motifs reported by Geluk et al. (J. Immunol. 152:5742–5748, 1994). The corresponding peptides are then synthesized and conformed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 184P1E2-Derived HTL Peptides

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 184P1E2-expressing tumors.

Example 18

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae $gf=1-(SQRT(1-af))$ (see, e.g., Sidney et al., Human Immunol. 45:79–93, 1996). To obtain overall phenotypic frequencies, cumulative gene frequencies are calculated, and the cumulative antigen frequencies derived by the use of the inverse formula $[af=1-(1-Cgf)^2]$.

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Immunogenicity studies in humans (e.g., Bertoni et al., J. Clin. Invest. 100:503, 1997; Doolan et al., Immunity 7:97, 1997; and Threlkeld et al., J. Immunol. 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition of Endogenously Processed Antigens after Printing

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 184P1E2 expression vectors.

The results demonstrate that CTL lines obtained from animals primed with peptide epitope recognize endogenously synthesized 184P1E2 antigen. The choice of transgenic mouse model to be used for such an analysis depends upon the epitope(s) that are being evaluated. In addition to HLA-A*0201/Kb transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a 184P1E2-derived CTL and HTL peptide vaccine compositions. The vaccine composition used herein comprise peptides to be administered to a patient with a 184P1E2-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., J. Immunol. 159:4753–4761, 1997). For example, A2/$K^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., J. Exp. Med. 173:1007, 1991)

In vitro CTL activation: One week after priming, spleen cells ($30 \times 10^6$ cells/flask) are co-cultured at 37° C. with syngeneic, irradiated (3000 rads), peptide coated lymphoblasts ($10 \times 10^6$ cells/flask) in 10 ml of culture medium/T25 flask. After six days, effector cells are harvested and assayed for cytotoxic activity.

Assay for cytotoxic activity: Target cells (1.0 to $1.5 \times 10^6$) are incubated at 37° C. in the presence of 200 µl of $^{51}$Cr. After 60 minutes, cells are washed three times and resuspended in R10 medium. Peptide is added where required at a concentration of 1 µg/ml. For the assay, $10^4$ $^{51}$Cr-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100× (experimental release–spontaneous release)/(maximum release–spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5 \times 10^5$ effector cells for 10,000 targets) in the absence of peptide and 5:1 (i.e., $5 \times 10^4$ effector cells for 10,000 targets) in the presence of peptide, the specific lytic units would be: $[(1/50,000)-(1/500,000)] \times (10^6) = 18$ LU.

The results are analyzed to assess the magnitude of the CTL responses of animals injected with the immunogenic CT/HTL conjugate vaccine preparation and are compared to the magnitude of the CTL response achieved using, for example, CTL epitopes as outlined above in the Example entitled "Confirmation of Immunogenicity." Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a 184P1E2-Specific Vaccine This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih.gov/.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to pro vide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 184P1E2, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 184P1E2.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 184P1E2, are selected such that multiple supermotifs/motifs are represented to ensure broad population coverage. Similarly, HLA class II epitopes are selected from 184P1E2 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683–692, 1996; Demotz et al., *Nature* 342:682–684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567–576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751–761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 µg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-Ab-restricted mice, for example, are immunized intramuscularly with 100 µg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751–761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299–S309, 1998) or recombinant vaccinia, for example, expressing a minigene or DNA encoding the complete protein of interest (see, e.g., Hanke et al., *Vaccine* 16:439–445, 1998; Sedegah et al., *Proc. Natl. Acad. Sci. USA* 95:7648–53, 1998; Hanke and McMichael, *Immunol. Letters* 66:177–181, 1999; and Robinson et al., *Nature Med.* 5:526–34, 1999).

For example, the efficacy of the DNA minigene used in a prime boost protocol is initially evaluated in transgenic mice. In this example, A2.1/K$^b$ transgenic mice are immunized IM with 100 µg of a DNA minigene encoding the immunogenic peptides including at least one HLA-A2 supermotif-bearing peptide. After an incubation period (ranging from 3–9 weeks), the mice are boosted IP with 10$^7$ pfu/mouse of a recombinant vaccinia virus expressing the same sequence encoded by the DNA minigene. Control mice are immunized with 100 µg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 184P1E2 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 184P1E2-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 µg, generally 100–5,000 µg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 184P1E2-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 184P1E2 Sequences

A native 184P1E2 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 184P1E2 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native 184P1E2, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The 184P1E2 peptide epitopes of the present invention are used in conjunction with epitopes from other target tumor-associated antigens, to create a vaccine composition that is useful for the prevention or treatment of cancer that expresses 184P1E2 and such other antigens. For example, a vaccine composition can be provided as a single polypeptide that incorporates multiple epitopes from 184P1E2 as well as tumor-associated antigens that are often expressed with a target cancer associated with 184P1E2 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 184P1E2. Such an analysis can be performed in a manner described by Ogg et al., *Science* 279:2103–2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 184P1E2 HLA A*020-specific CTL frequencies from HLA A*0201-positive individuals at different stages of disease or following immunization comprising a 184P1E2 peptide containing an A*0201 motif. Tetrameric complexes are synthesized as described (Musey et al, *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 3 μg for 5 minutes and resuspended in 50 μl of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 184P1E2 epitope, and thus the status of exposure to 184P1E2, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 184P1E2-associated disease or who have been vaccinated with a 184P1E2 vaccine.

For example, the class I restricted CTL response of persons who have been vaccinated may be analyzed. The vaccine may be any 184P1E2 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 μg/ml), and Herpes (10 mM) containing 10% heat-inactivated human AB serum (complete RPMI) and plated using microculture formats. A synthetic peptide comprising an epitope of the invention is added at 10 μg/ml to each well and HBV core 128–140 epitope is added at 1 µg/ml to each well as a source of T cell help during the first week of stimulation.

In the microculture format, 4×10⁵ PBMC are stimulated with peptide in 8 replicate cultures in 96-well round bottom plate in 100 µl/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and 10⁵ irradiated (3,000 rad) autologous feeder cells. The cultures are tested for cytotoxic activity on day 14. A positive CTL response requires two or more of the eight replicate cultures to display greater than 10% specific ⁵¹Cr release, based on comparison with non-diseased control subjects as previously described (Rehermann, et al., *Nature Med.* 2:1104, 1108, 1996; Rehermann et al., *J. Clin. Invest.* 97:1655–1665, 1996; and Rehermann et al. *J. Clin. Invest.* 98:1432–1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670–2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of ⁵¹Cr (Amersham Corp., Arlington Heights, Ill.) for 1 hour after which they are washed four times with HBSS.

Cytolytic activity is determined in a standard 4-h, split well ⁵¹Cr release assay using U-bottomed 96 well plates containing 3,000 targets/well. Stimulated PBMC are tested at effector/target (E/T) ratios of 20–50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 184P1E2 or a 184P1E2 vaccine.

Similarly, Class II restricted HTL responses may also be analyzed. Purified PBMC are cultured in a 96-well flat bottom plate at a density of 1.5×10⁵ cells/well and are stimulated with 10 µg/ml synthetic peptide of the invention, whole 184P1E2 antigen, or PHA. Cells are routinely plated in replicates of 4–6 wells for each condition. After seven days of culture, the medium is removed and replaced with fresh medium containing 10 U/ml IL-2. Two days later, 1 µCi ³H-thymidine is added to each well and incubation is continued for an additional 18 hours. Cellular DNA is then harvested on glass fiber mats and analyzed for ³H-thymidine incorporation. Antigen-specific T cell proliferation is calculated as the ratio of 3H-thymidine incorporation in the presence of antigen divided by the ³H-thymidine incorporation in the absence of antigen.

Example 29

Induction Of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing 184P1E2

Phase II trials are performed to study the effect of administering the CTL-HTL peptide compositions to patients having cancer that expresses 184P1E2. The main objectives of the trial are to determine an effective dose and regimen for inducing CTLs in cancer patients that express 184P1E2, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21–65 and represent diverse ethnic backgrounds. All of them have a tumor that expresses 184P1E2.

Clinical manifestations or antigen-specific T-cell responses are monitored to assess the effects of administering the peptide compositions. The vaccine composition is found to be both safe and efficacious in the treatment of 184P1E2-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5–5 mg at multiple sites. The nucleic acid (0.1 to 1000 μg) can also be administered using a gene gun. Following an incubation period of 3–4 weeks, a booster dose is then administered. The booster can be recombinant fowlpox virus administered at a dose of $5–10^7$ to $5×10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 184P1E2 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in viva. The induced CTL and HTL then destroy or facilitate destruction, respectively, of the target cells that bear the 184P1E2 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and Prostate 32:272, 1997). Although $2–50×10^6$ DC per patient are typically administered, larger number of DC, such as 107 or $10^8$ can also be provided. Such cell populations typically contain between 50–90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5×10^6$ DC, then the patient will be injected with a total of 2.5×10' peptide-loaded PBMC. The percent DC mobilized by an agent such as Progenipoietin™ is typically estimated to be between 2–10%, but can vary as appreciated by one of skill in the art.

Ex Vivo Activation of CTL/HTL Responses

Alternatively, ex vivo CTL or HTL responses to 184P1E2 antigens can be induced by incubating, in tissue culture, the patient's, or genetically compatible, CTL or HTL precursor cells together with a source of APC, such as DC, and immunogenic peptides. After an appropriate incubation time (typically about 7–28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 184P1E2. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 184P1E2 to isolate peptides corresponding to 184P1E2 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 184P1E2-encoding sequences, or any parts thereof, are used to detect, decrease, or inhibit expression of naturally occurring 184P1E2. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 184P1E2. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 184P1E2-encoding transcript.

Example 35

Purification of Naturally-Occurring or Recombinant 184P1E2 Using 184P1E2-Specific Antibodies Naturally occurring or recombinant 184P1E2 is substantially purified by immunoaffinity chromatography using antibodies specific for 184P1E2. An immunoaffinity column is constructed by covalently coupling anti-184P1E2 antibody to an activated chromatographic resin, such as CNBr-activated SEPHAROSE (Amersham Pharmacia Biotech). After the coupling, the resin is blocked and washed according to the manufacturer's instructions.

Media containing 184P1E2 are passed over the immunoaffinity column, and the column is washed under conditions that allow the preferential absorbance of 184P1E2 (e.g., high ionic strength buffers in the presence of detergent). The column is eluted under conditions that disrupt antibody/184P1E2 binding (e.g., a buffer of pH 2 to pH 3, or a high concentration of a chaotrope, such as urea or thiocyanate ion), and GCR.P is collected.

Example 36

Identification of Molecules which Interact with 184P1E2

184P1E2, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 184P1E2, washed, and any wells with labeled 184P1E2 complex are assayed. Data obtained using different concentrations of 184P1E2 are used to calculate values for the number, affinity, and association of 184P1E2 with the candidate molecules.

Example 37

In Vivo Assay for 184P1E2 Tumor Growth Promotion

The effect of the 184P1E2 protein on tumor cell growth is evaluated in vivo by evaluating tumor development and growth of cells expressing or lacking 184P1E2. For example, SCID mice are injected subcutaneously on each flank with $1 \times 10^6$ of either 3T3, bladder or lung cancer cell lines (e.g. UM-UC3, J82, CaLu1 and A427 cells) containing tkNeo empty vector or 184P1E2. At least two strategies may be used: (I) Constitutive 184P1E2 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tetracycline, etc., provided such promoters are compatible with the host cell systems. Tumor volume is then monitored by caliper measurement at the appearance of palpable tumors and followed over time to determine if 184P1E2-expressing cells grow at a faster rate and whether tumors produced by 184P1E2-expressing cells demonstrate characteristics of altered aggressiveness (e.g. enhanced metastasis, vascularization, reduced responsiveness to chemotherapeutic drugs).

Additionally, mice can be implanted with $1 \times 10^5$ of the same cells orthotopically to determine if 184P1E2 has an effect on local growth in the bladder or lung, and whether 184P1E2 affects the ability of the cells to metastasize, specifically to lymph nodes, adrenal, liver and bone (Miki T et al, Oncol Res. 2001; 12:209; Fu X et al, Int J Cancer. 1991, 49:938).

The assay is also useful to determine the 184P1E2 inhibitory effect of candidate therapeutic compositions, such as for example, 184P1E2 intrabodies, 184P1E2 antisense molecules and ribozymes.

Example 38

184P1E2 Monoclonal Antibody-Mediated Inhibition of Bladder and Lung Tumors In Vivo The significant expression of 184P1E2 in cancer tissues, together with its restrictive expression in normal tissues makes 184P1E2 a good target for antibody therapy. Similarly, 184P1E2 is a target for T cell-based immunotherapy. Thus, the therapeutic efficacy of anti-184P1E2 mAbs in human bladder cancer xenograft mouse models is evaluated by using recombinant cell lines such as UM-UC3-184P1E2, J82-184P1E2, and 3T3-184P1E2 (see, e.g., Kaighn, M. E., et al., Invest Urol, 1979. 17(1): p. 16–23). Similarly, anti-184P1E2 mAbs are evaluated in human lung cancer xenograft models using recombinant cell lines such as CaLU-184P1E2 and A427-184P1E2.

Antibody efficacy on tumor growth and metastasis formation is studied, e.g., in a mouse orthotopic bladder cancer xenograft models and mouse lung xenograft models. The antibodies can be unconjugated, as discussed in this Example, or can be conjugated to a therapeutic modality, as appreciated in the art. Anti-184P1E2 mAbs inhibit formation of both lung and bladder xenografts. Anti-184P1E2 mAbs also retard the growth of established orthotopic tumors and prolonged survival of tumor-bearing mice. These results indicate the utility of anti-184P1E2 mAbs in the treatment of local and advanced stages of lung and bladder cancer. (See, e.g., Saffran, D., et al., PNAS 10:1073–1078).

Administration of the anti-184P1E2 mAbs led to retardation of established orthotopic tumor growth and inhibition of metastasis to distant sites, resulting in a significant prolongation in the survival of tumor-bearing mice. These studies indicate that 184P1E2 as an attractive target for immunotherapy and demonstrate the therapeutic potential of anti-184P1E2 mAbs for the treatment of local and metastatic prostate cancer. This example demonstrates that unconjugated 184P1E2 monoclonal antibodies are effective to inhibit the growth of human bladder tumor xenografts and human lung xenografts grown in SCID mice; accordingly a combination of such efficacious monoclonal antibodies is also effective.

Tumor Inhibition Using Multiple Unconjugated 184P1E2 mAbs

Materials and Methods

184P1E2 Monoclonal Antibodies:

Monoclonal antibodies are raised against 184P1E2 as described in the Example entitled "Generation of 184P1E2 Monoclonal Antibodies (mAbs)." The antibodies are characterized by ELISA, Western blot, FACS, and immunoprecipitation for their capacity to bind 184P1E2. Epitope mapping data for the anti-184P1E2 mAbs, as determined by ELISA and Western analysis, recognize epitopes on the 184P1E2 protein. Immunohistochemical analysis of prostate cancer tissues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of UM-UC3 and CaLu1 tumor xenografts.

Cell Lines

The balder and lung carcinoma cell lines, UM-UC3, J82, CaLu1 and A427 as well as the fibroblast line NIH 3T3 (American Type Culture Collection) are maintained in DMEM supplemented with L-glutamine and 10% FBS.

A UM-UC3-184P1E2, J82-184P1E2, CaLu1-184P1E2, A427-184P1E2 and 3T3-184P1E2 cell populations are generated by retroviral gene transfer as described in Hubert, R. S., et al., Proc Natl Acad Sci USA, 1999. 96(25): 14523.

Xenograft Mouse Models.

Subcutaneous (s.c.) tumors are generated by injection of $1 \times 10^6$ cancer cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by caliper measurements, and the tumor volume is calculated as length×width×height. Mice with s.c. tumors greater than 1.5 cm in diameter are sacrificed.

Orthotopic injections are performed under anesthesia by using ketamine/xylazine. For bladder orthotopic studies, an incision is made through the abdomen to expose the bladder and tumor cells ($5 \times 10^5$) mixed with Matrigel are injected into the bladder capsule in a 10-μl volume. To monitor tumor growth, mice are palpated and blood is collected on a weekly basis to measure BTA levels. For lung orthopotic models, an incision is made through the abdominal muscles to expose the lung. Tumor cells ($5 \times 10^5$) mixed with matrigel are injected into the bronchioalveolar region of the right lung (McLemore T L et al, Cancer Res. 1988;48:2880). To monitor tumor growth, blood is collected on a weekly basis to measure CA 125 levels. The mice are segregated into groups for the appropriate treatments, with anti-184P1E2 or control mAbs being injected i.p.

Anti-184P1E2 mAbs Inhibit Growth of 184P1E2-Expressing Xenograft-Cancer Tumors

The effect of anti-184P1E2 mAbs on tumor formation is tested by using UM-UC3 and CaLu1 orthotopic models. As compared with the s.c. tumor model, the orthotopic model, which requires injection of tumor cells directly in the mouse bladder and lung, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987–90; Kubota, T., J Cell Biochem, 1994. 56(1): p. 4–8). The features make the orthotopic model more representative of human disease progression and allowed us to follow the therapeutic effect of mAbs on clinically relevant end points.

Accordingly, tumor cells are injected into the mouse bladder or lung, and 2 days later, the mice are segregated into two groups and treated with either: a) 200–500 μg, of anti-184P1E2 Ab, or b) PBS three times per week for two to five weeks.

A major advantage of the orthotopic cancer models is the ability to study the development of metastases. Formation of metastasis in mice bearing established orthotopic tumors is studies by IHC analysis on lung sections using an antibody against a tumor-specific cell-surface protein such as anti-CK20 for bladder cancer and anti-CEA antibody for lung cancer models (Lin S et al, Cancer Detect Prev. 2001; 25:202).

Mice bearing established orthotopic tumors are administered 1000 μg injections of either anti-184P1E2 mAb or PBS over a 4-week period. Mice in both groups are allowed to establish a high tumor burden, to ensure a high frequency of metastasis formation in mouse lungs. Mice then are killed and their bladders, livers, bone and lungs are analyzed for the presence of tumor cells by IHC analysis.

These studies demonstrate a broad anti-tumor efficacy of anti-184P1E2 antibodies on initiation and progression of prostate and kidney cancer in xenograft mouse models. Anti-184P1E2 antibodies inhibit tumor formation of tumors as well as retarding the growth of already established tumors and prolong the survival of treated mice. Moreover, anti-184P1E2 mAbs demonstrate a dramatic inhibitory effect on the spread of local bladder and lung tumor to distal sites, even in the presence of a large tumor burden. Thus, anti-184P1E2 mAbs are efficacious on major clinically relevant end points (tumor growth), prolongation of survival, and health.

Example 39

Therapeutic and Diagnostic Use of Anti-184P1E2 Antibodies in Humans

Anti-184P1E2 monoclonal antibodies are safely and effectively used for diagnostic, prophylactic, prognostic and/or therapeutic purposes in humans. Western blot and immunohistochemical analysis of cancer tissues and cancer xenografts with anti-184P1E2 mAb show strong extensive staining in carcinoma but significantly lower or undetectable levels in normal tissues. Detection of 184P1E2 in carcinoma and in metastatic disease demonstrates the usefulness of the mAb as a diagnostic and/or prognostic indicator. Anti-184P1E2 antibodies are therefore used in diagnostic applications such as immunohistochemistry of kidney biopsy specimens to detect cancer from suspect patients.

As determined by flow cytometry, anti-184P1E2 mAb specifically binds to carcinoma cells. Thus, anti-184P1E2 antibodies are used in diagnostic whole body imaging applications, such as radio immunoscintigraphy and radioimmunotherapy, (see, e.g., Potamianos S., et. al. Anticancer Res 20(2A):925–948 (2000)) for the detection of localized and metastatic cancers that exhibit expression of 184P1E2. Shedding or release of an extracellular domain of 184P1E2 into the extracellular milieu, such as that seen for alkaline phosphodiesterase B10 (Meerson, N. R., Hepatology 27:563–568 (1998)), allows diagnostic detection of 184P1E2 by anti-184P1E2 antibodies in serum and/or urine samples from suspect patients.

Anti-184P1E2 antibodies that specifically bind 184P1E2 are used in therapeutic applications for the treatment of cancers that express 184P1E2. Anti-184P1E2 antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-184P1E2 antibodies are tested for efficacy of tumor prevention and growth inhibition in the SCID mouse cancer xenograft models, e.g., kidney cancer models AGS-K3 and AGS-K6, (see, e.g., the Example entitled "184P1E2 Monoclonal Antibody-mediated Inhibition of Bladder and Lung Tumors In Vivo"). Conjugated and unconjugated anti-184P1E2 antibodies are used as a therapeutic modality in human clinical trials either alone or in combination with other treatments as described in following Examples.

Example 40

Human Clinical Trials for the Treatment and Diagnosis of Human Carcinomas Through Use of Human Anti-184P1E2 Antibodies In Vivo Antibodies are used in accordance with the present invention which recognize an epitope on 184P1E2, and are used in the treatment of certain tumors such as those listed in Table I. Based upon a number of factors, including 184P1E2-expression levels, tumors such as those listed in Table I are presently preferred indications. In connection with each of these indications, three clinical approaches are successfully pursued.

I.) Adjunctive therapy: In adjunctive therapy, patients are treated with anti-184P1E2 antibodies in combination with a chemotherapeutic or antineoplastic agent and/or radiation therapy. Primary cancer targets, such as those listed in Table I, are treated under standard protocols by the addition anti-184P1E2 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-184P1E2 antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

II.) Monotherapy: In connection with the use of the anti-184P1E2 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-184P1E2 antibodies, the radiolabeled antibodies are utilized as a diagnostic and/or imaging agent. In such a role, the labeled antibodies localize to both solid tumors, as well as, metastatic lesions of cells expressing 184P1E2. In connection with the use of the anti-184P1E2 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-184P1E2 antibody is used as an imaging agent in a Phase I human clinical trial in patients having a carcinoma that expresses 184P1E2 (by analogy see, e.g., Divgi et al. *J. Natl. Cancer Inst.* 83:97–104 (1991)). Patients are followed with standard anterior and posterior gamma camera. The results indicate that primary lesions and metastatic lesions are identified Dose and Route of Administration As appreciated by those of ordinary skill in the art, dosing considerations can be determined through comparison with the analogous products that are in the clinic. Thus, anti-184P1E2 antibodies can be administered with doses in the range of 5 to 400 mg/m$^2$, with the lower doses used, e.g., in connection with safety studies. The affinity of anti-184P1E2 antibodies relative to the affinity of a known antibody for its target is one parameter used by those of skill in the art for determining analogous dose regimens. Further, anti-184P1E2 antibodies that are fully human antibodies, as compared to the chimeric antibody, have slower clearance; accordingly, dosing in patients with such fully human anti-184P1E2 antibodies can be lower, perhaps in the range of 50 to 300 mg/m$^2$, and still remain efficacious. Dosing in mg/m 2, as opposed to the conventional measurement of dose in mg/kg, is a measurement based on surface area and is a convenient dosing measurement that is designed to include patients of all sizes from infants to adults.

Three distinct delivery approaches are useful for delivery of anti-184P1E2 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-184P1E2 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-184P1E2 antibodies. As will be appreciated, one criteria that can be utilized in connection with enrollment of patients is 184P1E2 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 184P1E2. Standard tests and follow-up are utilized to monitor each of these safety concerns. Anti-184P1E2 antibodies are found to be safe upon human administration.

Example 41

Human Clinical Trial Adjunctive Therapy with Human Anti-184P1E2 Antibody and Chemotherapeutic Agent A phase I human clinical trial is initiated to assess the safety of six intravenous doses of a human anti-184P1E2 antibody in connection with the treatment of a solid tumor, e.g., a cancer of a tissue listed in Table I. In the study, the safety of single doses of anti-184P1E2 antibodies when utilized as an adjunctive therapy to an antineoplastic or chemotherapeutic agent, such as cisplatin, topotecan, doxorubicin, adriamycin, taxol, or the like, is assessed. The trial design includes delivery of six single doses of an anti-184P1E2 antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
|---|---|---|---|---|---|---|
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 184P1E2. Standard tests and follow-up are utilized to monitor each of these safety concerns. Patients are also assessed for clinical outcome, and particularly reduction in tumor mass as evidenced by MRI or other imaging.

The anti-184P1E2 antibodies are demonstrated to be safe and efficacious, Phase II trials confirm the efficacy and refine optimum dosing.

Example 42

Human Clinical Trial: Monotherapy with Human Anti-184P1E2 Antibody

Anti-184P1E2 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-184P1E2 antibodies.

Example 43

Human Clinical Trial: Diagnostic Imagine with Anti-184P1E2 Antibody

Once again, as the adjunctive therapy discussed above is safe within the safety criteria discussed above, a human clinical trial is conducted concerning the use of anti-184P1E2 antibodies as a diagnostic imaging agent. The protocol is designed in a substantially similar manner to those described in the art, such as in Divgi et al. *J. Natl. Cancer Inst.* 83:97–104(1991). The antibodies are found to be both safe and efficacious when used as a diagnostic modality.

Example 44

Homology Comparison of 184P1E2 to Known Sequences

The 184P1E2 gene is homologous to a previously cloned gene, namely human peptidylarginine deiminase type III (gi 7706447). The 184P1E2 v.1 and 184P1E2 v.2 shows 99% identity to the published peptidylarginine deiminase type III over the length of the protein (FIG. 4B and Table LIII). While 184P1E2 v.1 differs from gi 7706447 by one amino acid at position 480 (FIG. 4B), 184P1E2 v.2 differs from gi 7706447 by two amino acids at positions 304 and 480 (Table LIII). In contrast, 184P1E2 v.3 is 100% identical to the published peptidylarginine deiminase type III See FIG. 4B and Table LIII). This indicates that 184P1E2 v.1, v.2 and v.3 represent SNPs of the same gene (see Table LII). The homology to peptidylarginine deiminase is maintained across species, as 184P1E2 is strongly homologous to mouse and rat peptidylarginine deiminase type III (FIGS. 4C and 4D). The 184P1E2 protein consists of 664 amino acids, with calculated molecular weight of 74.7 kDa, and pi of 5.3. 184P1E2 is an intracellular protein, with localization to the mitochondria and cytosol. 184P1E2 can also localize to the nucleus. Motif analysis revealed the presence of a protein arginine deaminase motif (PAD) over the entire length of the protein, and a cadherin signature at amino acid 314–362 (Table XXI).

Protein arginine deaminases represent a family of 4 arginine deaminase isoforms, all of which catalyses the post-translational conversion of arginine to citrulline residues in a calcium dependent manner (Kanno T et al, J Inv. Dermatol 2000, 115:813). Peptidylarginine deiminase III is also known as the hai follicle type of PAD as it is primarily expressed in epidermis and hair follicles (Watanabe K et al. Biochim Biophys Acta 1988, 966:375). The conversion of arginine to citrulline by PAD has profound effects on the primary structure of target proteins and their biological function. For example, deimination of myelin basic protein enhances its susceptibility to degradation by cathepsin, a condition associated with the pathology of multiple sclerosis (Pritzker L et al, Biochemistry 2000, 39:5382). Several epidermal proteins are deiminated by peptidylarginine deiminase III, including filaggrin, trichohyalin and keratin (Senshu T et al, Biochem. Biophy. Res. Comm 1996, 225: 712). Deimination of these substrates leads to their denaturation and to the eventual loss of cell integrity (Mizoguchi M et al, J. Histochem. Cytockem 1998, 46:1303). Peptidylarginine deaminase also acts as a regulator of cell proliferation and survival in some but not all tumor cells. While some tumor lines, such a acute leukemias, respond to peptidylarginine deaminase by undergoing cell arrest at G1 and/or S phases of the cell cycle and apoptosis, other cells are not affected by peptidylarginine deaminase (Gong H et al, Leukemia 2000, 14:826). In other cases, peptidylarginine deaminase provides a protective effect against apoptosis, such as in prostate cancer cells treated with taxol (Kang S et al, Mol Cell 2000, 10:331).

As mentioned above, a cadherin motif was identified at aa 316–342 of the 184P1E2 protein. Cadherins are a family of proteins that function in calcium-dependent cell adhesion. Cadherins preferentially interact with themselves, regulating cell adhesion and tight junctions (Nagafuchi A. Curr Opin Cell Biol. 2001, 13:600). Disruption of cadherin function results in unregulated cell growth and migration, often observed in cancer (Thiery JP, Chopin D. Cancer Metastasis Rev. 1999; 18:31;). As 184P1E2 is an intracellular protein, it is unlikely to, by itself, mediate cell—cell adhesion. However, the presence of a cadherin motif suggests that 184P1E2 participate in protein—protein interactions.

The presence of a peptidylarginine deaminase motif and protein—protein interaction domain along with its localization indicate that 184P1E2 functions in regulating protein interactions and signal transduction in mammalian cells, thereby regulating cell proliferation, survival, differentiation as well as, gene expression. These biological functions have a direct effect on tumor growth and progression.

Accordingly, when 184P1E2 functions as a regulator of cell growth, tumor formation, cell signaling or as a modulator of transcription involved in activating genes associated with survival, invasion, tumorigenesis or proliferation, 184P1E2 is used for therapeutic, diagnostic, prognostic and/or preventative purposes. In addition, when a molecule, such as a variant or SNP of 184P1E2 is expressed in cancerous tissues, such as those listed in Table I, they are used for therapeutic, diagnostic, prognostic and/or preventative purposes.

Example 45

Regulation of Transcription

The localization of 184P1E2 coupled to the presence of protein interaction domains within its sequence indicate that 184P1E2 modulates the transcriptional regulation of eukaryotic genes. Regulation of gene expression is confirmed, e.g., by studying gene expression in cells expressing or lacking 184P1E2. For this purpose, two types of experiments are performed.

In the first set of experiments, RNA from parental and 184P1E2-expressing cells are extracted and hybridized to commercially available gene arrays (Clontech) (Smid-Koopman E et al. Br J Cancer. 2000. 83:246). Resting cells as well as cells treated with FBS, androgen or growth factors are compared. Differentially expressed genes are identified in accordance with procedures known in the art. The differentially expressed genes are then mapped to biological pathways (Chen K et al. Thyroid. 2001. 11:41.).

In the second set of experiments, specific transcription al pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, 184P1E2 plays a role in gene regulation, and it is used as a target for diagnostic, prognostic, preventative and/or therapeutic purposes.

Example 46

Identification and Confirmation of Potential Signal Transduction Pathways

Many mammalian proteins have been reported to interact with signaling molecules and to participate in regulating signaling pathways. (J Neurochem. 2001; 76:217–223). Cadherins in particular have been associated with the β-catenin signaling cascade that control cell transformation and invasion (Gottardi C J et al, J. Cell Biol. 2001, 153:1049). Based on the presence of a cadherin motif 184P1E2 regulates signaling pathways important for cell growth and invasion. In addition, the 184P1E2 protein contains several phosphorylation sites (see Table XX) indicating an association with specific signaling cascades. Using immunoprecipitation and Western blotting techniques, proteins are identified that associate with 184P1E2 and mediate signaling events. Several pathways known to play a role in cancer biology can be regulated by 184P1E2, including phospholipid pathways such as P13K, AKT, etc, adhesion and migration pathways, including FAK, Rho, Rac-1, β-catenin, etc, as well as mitogenic/survival cascades such as ERK, p38, etc (Cell Growth Differ. 2000, 11:279; J Biol Chem. 1999, 274:801; Oncogene. 2000, 19:3003, J. Cell Biol. 1997, 138:913.).

To confirm that 184P1E2 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Re1; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress
7. TCF-luc, TCF/Lef; β-catenin, Adhesion/invasion Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 184P1E2 are mapped and used for the identification and validation of therapeutic targets. When 184P1E2 is involved in cell signaling, it is used as target for diagnostic, prognostic, preventative and/or therapeutic purposes.

Example 47

Involvement in Tumor Progression

Based on the documented role of peptidylarginine deiminase in cell growth, proliferation and survival (Kang S et al, Mol Cell 2000, 10:331), the 184P1E2 gene can contribute to the growth of cancer cells. The role of 184P1E2 in tumor growth is confirmed in a variety of primary and transfected cell lines including bladder and lung cell lines, as well as NIH 3T3 cells engineered to stably express 184P1E2. Parental cells lacking 184P1E2 and cells expressing 184P1E2 are evaluated for cell growth using a well-documented proliferation assay (Fraser S P, Grimes J A, Djamgoz M B. Prostate. 2000; 44:61, Johnson D E, Ochieng J, Evans S L. Anticancer Drugs. 1996, 7:288).

To confirm the role of 184P1E2 in the transformation process, its effect in colony forming assays is investigated. Parental NIH-3T3 cells lacking 184P1E2 are compared to NIH-3T3 cells expressing 184P1E2, using a soft agar assay under stringent and more permissive conditions (Song Z. et al. Cancer Res. 2000; 60:6730).

To confirm the role of 184P1E2 in invasion and metastasis of cancer cells, a well-established assay is used, e.g., a Transwell Insert System assay (Becton Dickinson) (Cancer Res. 1999; 59:6010). Control cells, including prostate, breast and kidney cell lines lacking 184P1E2 are compared to cells expressing 184P1E2. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

184P1E2 can also play a role in cell cycle and apoptosis. Parental cells and cells expressing 184P1E2 are compared for differences in cell cycle regulation using a well-established BrdU assay (Abdel-Malek Z A. J Cell Physiol. 1988, 136:247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 184P1E2, including normal and tumor bladder and lung cells. Engineered and parental cells are treated with various chemotherapeutic agents, such as etoposide, taxol, etc, and protein synthesis inhibitors, such as cycloheximide. Cells are stained with annexin V-FITC and cell death is measured by FACS analysis. The modulation of cell death by 184P1E2 can play a critical role in regulating tumor progression and tumor load.

When 184P1E2 plays a role in cell growth, transformation, invasion or apoptosis, it is used as a target for diagnostic, prognostic, preventative and/or therapeutic purposes.

Example 48

Involvement in Angiogenesis

Angiogenesis or new capillary blood vessel formation is necessary for tumor growth (Hanahan D, Folkman J. Cell. 1996, 86:353; Folkman J. Endocrinology. 1998 139:441). Based on the effect of phsophodieseterase inhibitors on endothelial cells, 184P1E2 plays a role in angiogenesis (DeFouw L et al, Microvasc Res 2001, 62:263). Several assays have been developed to measure angiogenesis in vitro and in vivo, such as the tissue culture assays endothelial cell tube formation and endothelial cell proliferation. Using these assays as well as in vitro neo-vascularization, the role of 184P1E2 in angiogenesis, enhancement or inhibition, is confirmed.

For example, endothelial cells engineered to express 184P1E2 are evaluated using tube formation and proliferation assays. The effect of 184P1E2 is also confirmed in animal models in vivo. For example, cells either expressing or lacking 184P1E2 are implanted subcutaneously in immunocompromised mice. Endothelial cell migration and angiogenesis are evaluated 5–15 days later using immunohistochemistry techniques. 184P1E2 affects angiogenesis, and it is used as a target for diagnostic, prognostic, preventative and/or therapeutic purposes

Example 49

Involvement in Protein—Protein Interactions

Cadherin motifs have been shown to mediate interaction with other proteins, specially similar cadherin proteins, thereby regulating cell adhesion and growth (Cavallaro U et al, Cancer Lett. 2002, 176:123; Kovacs E M et al, Curr Biol. 2002, 12:379). Using immunoprecipitation techniques as well as two yeast hybrid systems, proteins are identified that associate with 184P1E2. Immunoprecipitates from cells expressing 184P1E2 and cells lacking 184P1E2 are compared for specific protein—protein associations.

Studies are performed to confirm the extent of association of 184P1E2 with effector molecules, such as nuclear proteins, transcription factors, kinases, phsophates etc. Studies comparing 184P1E2 positive and 184P1E2 negative cells as well as studies comparing unstimulated/resting cells and cells treated with epithelial cell activators, such as cytokines, growth factors, androgen and anti-integrin Ab reveal unique interactions.

In addition, protein—protein interactions are confirmed using two yeast hybrid methodology (Curr Opin Chem Biol. 1999, 3:64). A vector carrying a library of proteins fused to the activation domain of a transcription factor is introduced into yeast expressing a 184P1E2-DNA-binding domain fusion protein and a reporter construct. Protein-protein interaction is detected by colorimetric reporter activity. Specific association with effector molecules and transcription factors directs one of skill to the mode of action of 184P1E2, and thus identifies therapeutic, prognostic, preventative and/or diagnostic targets for cancer. This and similar assays are also used to identify and screen for small molecules that interact with 184P1E2.

Thus it is found that 184P1E2 associates with proteins and small molecules. Accordingly, 184P1E2 and these proteins and small molecules are used for diagnostic, prognostic, preventative and/or therapeutic purposes.

Example 50

Involvement in Deimination

As previously mentioned, petidylarginine deiminases convert protein-bound arginine to citrulline, thereby altering the structure and function of target proteins (Kanno T et al, J Inv. Dermatol 2000, 115:813). The petidylarginine deiminases of 184P1E2 will be confirmed in recombinant cell lines as well as primary bladder and lung tumor cells. Cells expressing 184P1E2 and control cells lacking 184P1E2 are grown on sterile glass coverslips, and fixed in paraformaldehyde. Citrulline residues located in cellular proteins are chemically altered for better recognition using potassium ferricyanide. Citrulline residues are detected using a citrulline-specific antibody by immunofluorescence.

When 184P1E2 functions as a deiminase, it is used as a target for diagnostic, prognostic, preventative and therapeutic purposes.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLE 1: Tissues that Express 184P1E2 when Malignant

Bladder

Kidney

Lung

TABLE II

Amino Acid Abbreviations

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0 BLOSUM62 amino acid substitution matrix (block substitution matrix). The higher the value, the more likely a substitution is found in related, natural proteins.

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | -2 | -1 | -2 | 0 | -2 | -1 | -1 | -1 | -1 | -2 | -1 | -1 | -1 | 1 | 0 | 0 | -3 | -2 | A |
|  | 9 | -3 | -4 | -2 | -3 | -3 | -1 | -3 | -1 | -1 | -3 | -3 | -3 | -3 | -1 | -1 | -1 | -2 | -2 | C |
|  |  | 6 | 2 | -3 | -1 | -1 | -3 | -1 | -4 | -3 | 1 | -1 | 0 | -2 | 0 | -1 | -3 | -4 | -3 | D |
|  |  |  | 5 | -3 | -2 | 0 | -3 | 1 | -3 | -2 | 0 | -1 | 2 | 0 | 0 | -1 | -2 | -3 | -2 | E |
|  |  |  |  | 6 | -3 | -1 | 0 | -3 | 0 | 0 | -3 | -4 | -3 | -3 | -2 | -2 | -1 | 1 | 3 | F |
|  |  |  |  |  | 6 | -2 | -4 | -2 | -4 | -3 | 0 | -2 | -2 | -2 | 0 | -2 | -3 | -2 | -3 | G |
|  |  |  |  |  |  | 8 | -3 | -1 | -3 | -2 | 1 | -2 | 0 | 0 | -1 | -2 | -3 | -2 | 2 | H |
|  |  |  |  |  |  |  | 4 | -3 | 2 | 1 | -3 | -3 | -3 | -3 | -2 | -1 | 3 | -3 | -1 | I |
|  |  |  |  |  |  |  |  | 5 | -2 | -1 | 0 | -1 | 1 | 2 | 0 | -1 | -2 | -3 | -2 | K |
|  |  |  |  |  |  |  |  |  | 4 | 2 | -3 | -3 | -2 | -2 | -2 | -1 | 1 | -2 | -1 | L |
|  |  |  |  |  |  |  |  |  |  | 5 | -2 | -2 | 0 | -1 | -1 | -1 | 1 | -1 | -1 | M |
|  |  |  |  |  |  |  |  |  |  |  | 6 | -2 | 0 | 0 | 1 | 0 | -3 | -4 | -2 | N |
|  |  |  |  |  |  |  |  |  |  |  |  | 7 | -1 | -2 | -1 | -1 | -2 | -4 | -3 | P |
|  |  |  |  |  |  |  |  |  |  |  |  |  | 5 | 1 | 0 | -1 | -2 | -2 | -1 | Q |
|  |  |  |  |  |  |  |  |  |  |  |  |  |  | 5 | -1 | -1 | -3 | -3 | -2 | R |
|  |  |  |  |  |  |  |  |  |  |  |  |  |  |  | 4 | 1 | -2 | -3 | -2 | S |
|  |  |  |  |  |  |  |  |  |  |  |  |  |  |  |  | 5 | 0 | -2 | -2 | T |
|  |  |  |  |  |  |  |  |  |  |  |  |  |  |  |  |  | 4 | -3 | -1 | V |
|  |  |  |  |  |  |  |  |  |  |  |  |  |  |  |  |  |  | 11 | 2 | W |
|  |  |  |  |  |  |  |  |  |  |  |  |  |  |  |  |  |  |  | 7 | Y |

TABLE IV

HLA Class I/II Motifs/Supermotifs

TABLE IV (A): HLA Class I Supermotifs/Motifs

| SUPERMOTIFS | POSITION | POSITION | POSITION |
|---|---|---|---|
|  | 2 (Primary Anchor) | 3 (Primary Anchor) | C Terminus (Primary Anchor) |
| A1 | TI*LVMS* |  | FWY |
| A2 | LIVM*ATQ* |  | IVM*ATL* |
| A3 | VSMA*TLI* |  | RK |
| A24 | YF*WIVLMT* |  | FI*YWLM* |
| B7 | P |  | VILF*MWYA* |
| B27 | RHK |  | FYL*WMIVA* |
| B44 | E*D* |  | FWYLIMVA |
| B58 | ATS |  | FWY*LIVMA* |
| B62 | QL*IVMP* |  | FWYMIVLA |
| MOTIFS |  |  |  |
| A1 | TSM |  | Y |
| A1 |  | DE*AS* | Y |
| A2.1 | LM*VQIAT* |  | V*LIMAT* |
| A3 | LMVISATF*CGD* |  | KYR*HFA* |
| A11 | VTMLISAGN*CDF* |  | KRY*H* |
| A24 | YF*WM* |  | FLIW |
| M3101 | MVT*ALIS* |  | R*K* |
| A*3301 | MVALF*IST* |  | RK |
| A*6801 | AVT*MSLI* |  | RK |
| B*0702 | P |  | LMF*WYAIV* |
| B*3501 | P |  | LMFWY*IVA* |
| B51 | P |  | LIVF*WYAM* |
| B*5301 | P |  | IMFWY*ALV* |
| B*5401 | P |  | ATIV*LMFWY* |

Bolded residues are preferred, italicized residues are less preferred: A peptide is considered motif-bearing if it has primary anchors at each primary anchor position for a motif or supermotif as specified in the above table.

TABLE IV (B): HLA Class II Supermotif

| 1 | 6 | 9 |
|---|---|---|
| W, F, Y, V, I, L | A, V, I, L, P, C, S, T | A, V, I, L, C, S, T, M, Y |

TABLE IV (C): HLA Class II Motifs

| MOTIFS |  | 1° anchor 1 | 2 | 3 | 4 | 5 | 1° anchor 6 | 7 | Σ |
|---|---|---|---|---|---|---|---|---|---|
| DR4 | preferred | FMY*LIVW* | M | T | W | I | VSTC*PALIM* | MH |  |
|  | deleterious |  |  |  |  |  |  | R |  |
| DR1 | preferred | MF*LIVWY* | C | CH | PAMQ |  | VMAT*SPLIC* | M | τ |
|  | deleterious |  |  |  | FD | CWD |  | GDE |  |
| DR7 | preferred | MF*LIVWY* | M | W | A |  | IVMSA*CTPL* | M | Γ |
|  | deleterious |  | C |  | G |  |  | GRD |  |
| DR3 | MOTIFS | 1° anchor 1 | 2 | 3 | 1° anchor 4 | 5 | 1° anchor 6 |  |  |
| motif a preferred |  | LIVMFY |  |  | D |  |  |  |  |
| motif b preferred |  | LIVMFAY |  |  | DNQEST | KRH |  |  |  |
| DR Supermotif |  | MF*LIVWY* |  |  |  |  | VMSTA*CPLI* |  |  |

Italicized residues indicate less preferred or "tolerated" residues

TABLE IV (D): HLA Class I Supermotifs

| SUPER-MOTIFS | POSITION: | 1 | 2 | 3 | 4 | 5 | 6 | 7 | 8 |
|---|---|---|---|---|---|---|---|---|---|
| A1 |  |  | 1° Anchor |  |  |  |  |  |  |
|  |  |  | TI*LVMS* |  |  |  |  |  |  |
| A2 |  |  | 1° Anchor |  |  |  |  |  |  |
|  |  |  | LIVM*ATQ* |  |  |  |  |  |  |
| A3 | preferred | DE (3/5); | 1° Anchor | YFW |  |  | YFW | YFW | P |
|  | deleterious | P (5/5) | VSMA*TLI* | (4/5) |  |  | (3/5) | (4/5) | (4/5) |
|  |  |  | DE |  |  |  |  |  |  |
|  |  |  | (4/5) |  |  |  |  |  |  |

TABLE IV-continued

| | | | HLA Class I/II Motifs/Supermotifs | | | | | |
|---|---|---|---|---|---|---|---|---|
| A24 | | | 1° Anchor | | | | | |
| | | | YF*WIVLMT* | | | | | |
| B7 | preferred | FWY (5/5) | 1° Anchor | FWY | DE | G | QN | FWY |
| | deleterious | LIVM (3/5) DE (3/5); P (5/5); G (4/5); A (3/5); QN (3/5) | P | (4/5) | (3/5) | (4/5) | (4/5) | (3/5) DE (4/5) |
| B27 | | | 1° Anchor | | | | | |
| | | | RHK | | | | | |
| B44 | | | 1° Anchor | | | | | |
| | | | ED | | | | | |
| B58 | | | 1° Anchor | | | | | |
| | | | ATS | | | | | |
| B62 | | | 1° Anchor | | | | | |
| | | | QL*IVMP* | | | | | |

Italicized residues indicate less preferred or "tolerated" residues

TABLE IV (E): HLA Class I Motifs

| | POSITION: | 1 | 2 | 3 | 4 | 5 | 6 | 7 | 8 | |
|---|---|---|---|---|---|---|---|---|---|---|
| A1 | preferred | GFY | 1° Anchor | DEA | YFW | G | P | DEQN | YFW | C- |
| 9-mer | deleterious | W DE | STM | RHKLIVMP | A | | A | | | 1' |
| A1 | preferred | GRHK | ASTCLIVM | 1° Anchor | GSTC | PQN | ASTC | LIVM | DE | 1' |
| 9-mer | deleterious | A | RHKDEPY FW | DE*AS* | DE | | RHK | PG | GP | |
| A1 | preferred | YFW | 1° Anchor | DEAQN | A | YFWQN | QNA | PASTC | GDE | |
| 10-mer | deleterious | GP | STM | RHKGLIVM | DE | RHK | | RHKYFW | RHK | |
| A1 | preferred | YFW | STCLIVM | 1° Anchor | A | YFW | G | PG | G | |
| 10-mer | deleterious | RHK | RHKDEPY FW | DE*AS* | | P | | | PRHK | |
| A2.1 | preferred | YFW | 1° Anchor | YFW | STC | YFW | RKH | A | P | 1' |
| 9-mer | deleterious | DEP | LM*IVQAT* | DERKH | | | | DERKH | | V |
| A2.1 | preferred | AYFW | 1° Anchor | LVIM | G | P | G | RKH | FYWL | |
| 10-mer | deleterious | DEP | LM*IVQA T* | DE | RKHA | | | VIM DERKH | | |
| A3 | preferred | RHK | 1° Anchor | YFW | PRHKYFW | A | YFW | | P | 1' |
| | deleterious | DEP | LMVISA TFCGD | DE | | | | | | K |
| A11 | preferred | A | 1° Anchor | YFW | YFW | A | YFW | YFW | P | 1' |
| | deleterious | DEP | VTLMIS AGN*CDF* | | | | | A | G | |
| A24 | preferred | YFWRHK | 1° Anchor | DE | STC | QNP | DERH | YFW | YFW | 1' |
| 9-mer | deleterious | DEG | YFW*M* | | G | | K | G | AQN | |
| A24 | preferred | | 1° Anchor | GDE | P | YFWP | DE | P | QN | |
| 10-mer | deleterious | | YFW*M* | | QN | RHK | | A | AP | |
| A3101 | preferred | RHK | 1° Anchor | YFW | P | ADE | YFW | YFW | AP | 1' |
| | deleterious | DEP | MVT*ALIS* | DE | | | DE | DE | DE | |
| A3301 | preferred | GP | 1° Anchor | YFW | | | | AYFW | | 1' |
| | deleterious | | MVALF*I ST* | DE | | | | | | |

TABLE IV-continued

HLA Class I/II Motifs/Supermotifs

| | | | | | | | | | | |
|---|---|---|---|---|---|---|---|---|---|---|
| A6801 | preferred | YFWSTC | 1° Anchor | DEG | | YFWLIV | | YFW | P | 1° A |
| | deleterious | GP | AVT*MSLI* | | | M | | | A | |
| B0702 | preferred | RHKFW | 1° Anchor | RHK | DE | RHK | RHK | RHK | PA | 1° A |
| | deleterious | Y<br>DEQNP | P | DEP | | GDE | QN | DE | LMP | |
| B3501 | preferred | FWYLIV | 1° Anchor | FWY | | G | | G | FWY | 1° A |
| | deleterious | M<br>AGP | P | | | | | | | LMI |
| B51 | preferred | LIVMFW | 1° Anchor | FWY | STC | FWY | G | G | FWY | 1° A |
| | deleterious | Y<br>AGPDER<br>HKSTC | P | | | DE | DEQN | GDE | LIVI | |
| B5301 | preferred | LIVMFW | 1° Anchor | FWY | STC | FWY | G | LIVMFWY | FWY | 1° A |
| | deleterious | Y<br>AGPQN | P | | | | RHKQN | DE | IMF | |
| B5401 | preferred | FWY | 1° Anchor | FWYL | | LIVM | DE | ALIVM | FWYAP | 1° A |
| | deleterious | GPQNDE | P | IVM<br>GDES<br>TC | | RHKDE | QNDGE | DE | ATI | |

Italicized residues indicate less preferred or "tolerated" residues.
The information in this Table is specific for 9-mers unless otherwise

TABLE V

| Pos | 123456789 | Score | SeqID |
|---|---|---|---|
| | v.1-A1-9mers: 184P1E2 | | |
| 99 | SHEPLPLAY | 112.500 | 46 |
| 373 | NGELQDFPY | 56.250 | 47 |
| 566 | IIDIPQLFK | 50.000 | 48 |
| 620 | LLEPLGLHC | 45.000 | 49 |
| 22 | GVETLVDIY | 45.000 | 50 |
| 348 | IQDEMELGY | 18.750 | 51 |
| 301 | STLPPLEVY | 12.500 | 52 |
| 218 | GPEDVCEAY | 11.250 | 53 |
| 285 | FTDTVVFRV | 6.250 | 54 |
| 120 | DCDLNCEGR | 5.000 | 55 |
| 271 | LLDDSNEDF | 5.000 | 56 |
| 62 | RADTRRWRF | 5.000 | 57 |
| 561 | LAECDIIDI | 4.500 | 58 |
| 36 | GTEMFEVYG | 4.500 | 59 |
| 563 | ECDIIDIPQ | 2.500 | 60 |
| 383 | RILGPDFGY | 2.500 | 61 |
| 386 | GPDFGYVTR | 2.500 | 62 |
| 490 | LASPGACFK | 2.000 | 63 |
| 73 | TLEIIVVMN | 1.800 | 64 |
| 409 | NLEVSPPVV | 1.800 | 65 |
| 176 | DLEDMSVMV | 1.800 | 66 |
| 43 | YGTPGVDIY | 1.250 | 67 |
| 362 | KTLPVVFDS | 1.250 | 68 |
| 517 | VVDDEQVKT | 1.000 | 69 |
| 454 | KVQPPVELF | 1.000 | 70 |
| 587 | LVNMLVLGK | 1.000 | 71 |
| 462 | FVDWLAVGH | 1.000 | 72 |
| 335 | TICPQAENR | 1.000 | 73 |
| 446 | VRDFLHAQK | 1.000 | 74 |
| 630 | FIDDFTPYH | 1.000 | 75 |
| 229 | VLGQDKVSY | 1.000 | 76 |
| 534 | NKDLINYNK | 1.000 | 77 |
| 612 | CLEEKVRSL | 0.900 | 78 |
| 222 | VCEAYRHVL | 0.900 | 79 |
| 351 | EMELGYVQA | 0.900 | 80 |
| 339 | QAENRNDRW | 0.900 | 81 |
| 323 | VAELARKAG | 0.900 | 82 |
| 10 | SLEHPTSAV | 0.900 | 83 |
| 124 | NCEGRQDRN | 0.900 | 84 |
| 243 | HGDEERFFV | 0.625 | 85 |
| 480 | APDKGFRM | 0.625 | 86 |
| 584 | FPDLVNMLV | 0.625 | 87 |
| 198 | KLVLHTSSY | 0.500 | 88 |
| 319 | FVDAVAELA | 0.500 | 89 |
| 470 | HVDEFLSFV | 0.500 | 90 |
| 186 | RTQGPAALF | 0.500 | 91 |
| 47 | GVDIYISPN | 0.500 | 92 |
| 547 | CIDWNREVL | 0.500 | 93 |
| 166 | NCDQHVHCL | 0.500 | 24 |
| 202 | HTSSYDAKR | 0.500 | 95 |
| 574 | KTERKKATA | 0.450 | 96 |
| 393 | TREPRDRSV | 0.450 | 97 |
| 250 | FVEGLSFPD | 0.450 | 98 |
| 321 | DAVAELARK | 0.400 | 99 |
| 532 | LSNKDLINY | 0.375 | 100 |
| 174 | LQDLEDMSV | 0.375 | 101 |
| 412 | VSPPVVANG | 0.300 | 102 |
| 128 | RQDRNFVDK | 0.300 | 103 |
| 432 | GNLPGSSGR | 0.250 | 104 |
| 647 | GTNVCRKPF | 0.250 | 105 |
| 103 | LPLAYAVLY | 0.250 | 106 |
| 156 | RDDPSCDVQ | 0.250 | 107 |
| 478 | VPAPDGKGF | 0.250 | 108 |
| 641 | HGEVHCGTN | 0.225 | 109 |
| 236 | SYEVPRLHG | 0.225 | 110 |
| 253 | GLSEPDAGF | 0.200 | 111 |
| 302 | TLPPLEVYV | 0.200 | 112 |
| 645 | HCGTNVCRK | 0.200 | 113 |
| 411 | EVSPPVVAN | 0.200 | 114 |
| 527 | SINQVLSNK | 0.200 | 115 |
| 516 | GVVDDEQVK | 0.200 | 116 |
| 489 | LLASPGACF | 0.200 | 117 |
| 375 | ELQDFPYKR | 0.200 | 118 |
| 399 | RSVSGLDSF | 0.150 | 119 |
| 254 | LSFPDAGFT | 0.150 | 120 |
| 52 | ISPNMERGR | 0.150 | 121 |
| 31 | GSVPEGTEM | 0.150 | 122 |
| 261 | FTGLISFHV | 0.125 | 123 |

TABLE V-continued

| Pos | 123456789 | Score | SeqID |
|---|---|---|---|
| 506 | CGHGRALLF | 0.125 | 124 |
| 634 | FTPYHMLHG | 0.125 | 125 |
| 259 | AGFTGLISF | 0.125 | 126 |
| 35 | EGTEMFEVY | 0.125 | 127 |
| 44 | GTPGVDIYI | 0.125 | 128 |
| 88 | NDSHVQISY | 0.125 | 129 |
| 256 | FPDAGFTGL | 0.125 | 130 |
| 177 | LEDMSVMVL | 0.125 | 131 |
| 84 | SNDLNDSHV | 0.125 | 132 |
| 193 | LFDDHKLVL | 0.125 | 133 |
| 87 | LNDSHVQIS | 0.125 | 134 |
| 33 | VPEGTEMFE | 0.113 | 135 |
| 433 | NLPGSSGRR | 0.100 | 136 |
| 610 | CCCLEEKVR | 0.100 | 137 |
| 51 | YISPNMERG | 0.100 | 138 |
| 354 | LGYVQAPHK | 0.100 | 139 |
| 466 | LAVGHVDEF | 0.100 | 140 |
| 241 | RLHGDEERF | 0.100 | 141 |
| 32 | SVPEGTEMF | 0.100 | 142 |
| 384 | ILGPDFGYV | 0.100 | 143 |
| 565 | DIIDIPQLF | 0.100 | 144 |
| 153 | NCDRDDPSC | 0.100 | 145 |
| v.2-A1-9mers: 184P1E2 | | | |
| 6 | STLAPLEVY | 1.250 | 146 |
| 7 | TLAPLEVYV | 0.200 | 147 |
| 9 | APLEVYVCP | 0.050 | 148 |
| 3 | MTPSTLAPL | 0.050 | 149 |
| 2 | IMTPSTLAP | 0.025 | 150 |
| 8 | LAPLEVYVC | 0.020 | 151 |
| 1 | WIMTPSTLA | 0.010 | 152 |
| 5 | PSTLAPLEV | 0.008 | 153 |
| 4 | TPSTLAPLE | 0.001 | 154 |
| v.3-A1-9mers:184P1E2 | | | |
| 9 | VPDGKGFRM | 0.625 | 155 |
| 7 | VPVPDGKGP | 0.250 | 156 |
| 5 | SFVPVPDGK | 0.100 | 157 |
| 4 | LSPVPVPDG | 0.030 | 158 |
| 8 | PVPDGKGFR | 0.010 | 159 |
| 6 | FVPVPDGKG | 0.010 | 160 |
| 3 | FLSFVPVPD | 0.002 | 161 |
| 1 | DEFLSPVPV | 0.001 | 162 |
| 2 | EFLSFVPVP | 0.000 | 163 |

TABLE VI

| Pos | 123456789 | Score | SeqID |
|---|---|---|---|
| v.1-A1-10mers: 184P1E2 | | | |
| 87 | LNDSHVQISY | 31.250 | 164 |
| 319 | FVDAVAELAR | 25.000 | 165 |
| 547 | CIDWNREVLK | 20.000 | 166 |
| 373 | NCELQDFPYK | 9.000 | 167 |
| 124 | NCEGRQDRNF | 9.000 | 168 |
| 620 | LLEPLGLHCT | 9.000 | 169 |
| 218 | GPEDVCEAYR | 4.500 | 170 |
| 22 | GVETLVDIYG | 4.500 | 171 |
| 36 | GTEMFEVYGT | 4.500 | 172 |
| 73 | TLEIIVVMNS | 4.500 | 173 |
| 176 | DLEDMSVMVL | 4.500 | 174 |
| 98 | SSHEPLPLAY | 3.750 | 175 |
| 412 | VSPPVVANGK | 3.000 | 176 |
| 403 | GLDSFGNLEV | 2.500 | 177 |
| 347 | WIQDEMELGY | 2.500 | 178 |
| 566 | IIDIPQLFKT | 2.500 | 179 |
| 531 | VLSNKDLINY | 2.500 | 180 |
| 574 | KTERKKATAF | 2.250 | 181 |
| 10 | SLEHPTSAVC | 1.800 | 182 |
| 409 | NLEVSPPVVA | 1.800 | 183 |
| 250 | FVEGLSFPDA | 1.800 | 184 |
| 222 | VCEAYRHVLG | 1.800 | 185 |
| 323 | VAELARKAGC | 1.800 | 186 |

TABLE VI-continued

| Pos | 123456789 | Score | SeqID |
|---|---|---|---|
| 31 | GSVPEGTEMF | 1.500 | 187 |
| 628 | CTFIDDPTPY | 1.250 | 188 |
| 285 | FTDTVVFRVA | 1.250 | 189 |
| 33 | VPEGTEMFEV | 1.125 | 190 |
| 47 | GVDIYISPNM | 1.000 | 191 |
| 228 | HVLGQDKVSY | 1.000 | 192 |
| 565 | DIIDIPQLFK | 1.000 | 193 |
| 630 | FIDDFTPYHM | 1.000 | 194 |
| 586 | DLVNMLVLGK | 1.000 | 195 |
| 51 | YISPNMERGR | 1.000 | 196 |
| 563 | ECDIIDIPQL | 1.000 | 197 |
| 339 | QAENRNDRWI | 0.900 | 198 |
| 305 | PLEVYVCRVR | 0.900 | 199 |
| 99 | SHEPLPLAYA | 0.900 | 200 |
| 612 | CLEEKVRSLL | 0.900 | 201 |
| 254 | LSFPDAGFTG | 0.750 | 202 |
| 584 | FPDLVNMLVL | 0.625 | 203 |
| 372 | RNGELQDFPY | 0.625 | 204 |
| 490 | LASPGACFKL | 0.500 | 205 |
| 454 | KVQPPVELFV | 0.500 | 206 |
| 505 | KCGHGRALLF | 0.500 | 207 |
| 276 | NEDFSASPIF | 0.500 | 208 |
| 166 | NCDQHVHCLQ | 0.500 | 209 |
| 120 | DCDLNCEGRQ | 0.500 | 210 |
| 462 | FVDWLAVGHV | 0.500 | 211 |
| 517 | VVDDEQVKTI | 0.500 | 212 |
| 118 | SLDCDLNCEG | 0.500 | 213 |
| 114 | CVDISLDCDL | 0.500 | 214 |
| 160 | SCDVQDNCDQ | 0.500 | 215 |
| 49 | DIYISPNMER | 0.500 | 216 |
| 258 | DAGFTGLISF | 0.500 | 217 |
| 271 | LLDDSNEDFS | 0.500 | 218 |
| 301 | STLPPLEVYV | 0.500 | 219 |
| 177 | LEDMSVMVLR | 0.500 | 220 |
| 393 | TREPRDRSVS | 0.450 | 221 |
| 353 | ELGYVQAPHK | 0.400 | 222 |
| 526 | ISINQVLSNK | 0.300 | 223 |
| 475 | LSFVPAPDGK | 0.300 | 224 |
| 470 | HVDEFLSFVP | 0.250 | 225 |
| 534 | NKDLINYNKF | 0.250 | 226 |
| 334 | LTICPQAENR | 0.250 | 227 |
| 205 | SYDAKRAQVF | 0.250 | 228 |
| 478 | VPAPDGKGFR | 0.250 | 229 |
| 432 | GNLPGSSGRR | 0.250 | 230 |
| 641 | HGEVHCGTNV | 0.225 | 231 |
| 519 | DDEQVKTISI | 0.225 | 232 |
| 275 | SNEDFSASPI | 0.225 | 233 |
| 489 | LLASPGACFK | 0.200 | 234 |
| 488 | MLLASPGACF | 0.200 | 235 |
| 494 | GACFKLFQEK | 0.200 | 236 |
| 643 | EVHCGTNVCR | 0.200 | 237 |
| 302 | TLPPLEVYVC | 0.200 | 238 |
| 384 | ILGPDFGYVT | 0.200 | 239 |
| 411 | EVSPPVVANG | 0.200 | 240 |
| 200 | VLHTSSYDAK | 0.200 | 241 |
| 491 | ASPGACFKLF | 0.150 | 242 |
| 112 | LTCVDISLDC | 0.125 | 243 |
| 21 | AGVETLVDIY | 0.125 | 244 |
| 580 | ATAFFPDLVN | 0.125 | 245 |
| 272 | LDDSNEDFSA | 0.125 | 246 |
| 256 | FPDAGFTGLI | 0.125 | 247 |
| 468 | VGHVDBPLSF | 0.125 | 248 |
| 194 | FDDHKLVLHT | 0.125 | 249 |
| 69 | RFDATLEIIV | 0.125 | 250 |
| 43 | YGTPGVDIYI | 0.125 | 251 |
| 442 | VTQVVRDFLH | 0.125 | 252 |
| 84 | SNDLNDSHVQ | 0.125 | 253 |
| 382 | KRILGPDFGY | 0.125 | 254 |
| 480 | APDGKGFRML | 0.125 | 255 |
| 217 | CGPEDVCEAY | 0.125 | 256 |
| 648 | TNVCRKPFSF | 0.125 | 257 |
| 609 | GCCCLEEKVR | 0.100 | 258 |
| 625 | GLHCTFIDDF | 0.100 | 259 |
| 335 | TICPQAENRN | 0.100 | 260 |
| 280 | SASPIFTDTV | 0.100 | 261 |
| 241 | RLHGDEERPF | 0.100 | 262 |
| 122 | DLNCEGRQDR | 0.100 | 263 |

TABLE VI-continued

| Pos | 123456789 | Score | SeqID |
|---|---|---|---|
| | v.2-A1-10mers: 184P1E2 | | |
| 9 | LAPLEVYVCR | 0.200 | 264 |
| 8 | TLAPLEVYVC | 0.200 | 265 |
| 3 | IMTPSTLAPL | 0.100 | 266 |
| 6 | PSTLAPLEVY | 0.075 | 267 |
| 7 | STLAPLEVYV | 0.050 | 268 |
| 5 | TPSTLAPLEV | 0.013 | 269 |
| 4 | MTPSTLAPLE | 0.005 | 270 |
| 2 | WIMTPSTLAP | 0.005 | 271 |
| 10 | APLEVYVCRV | 0.003 | 272 |
| 1 | PWIMTPSTLA | 0.000 | 273 |
| | v.2-A1-10mers: 184P1E2 | | |
| 5 | LSFVPVPDGK | 0.300 | 274 |
| 8 | VPVPDGKGFR | 0.250 | 275 |
| 10 | VPDGKGFRML | 0.125 | 276 |
| 7 | FVPVPDGKGF | 0.100 | 277 |
| 1 | VDEFLSFVPV | 0.090 | 278 |
| 4 | FLSPVPVPDG | 0.020 | 279 |
| 6 | SFVPVPDGKG | 0.005 | 280 |
| 9 | PVPDGKGFRM | 0.005 | 281 |
| 2 | DEFLSFVPVP | 0.000 | 282 |
| 3 | EFLSFVPVPD | 0.000 | 283 |

TABLE VII

| Pos | 123456789 | Score | SeqID |
|---|---|---|---|
| | v.1-A2-9mers: 184P1E2 | | |
| 192 | ALFDDHKLV | 1055.104 | 284 |
| 302 | TLPPLEVYV | 382.536 | 285 |
| 384 | ILGPDFGYV | 160.627 | 286 |
| 111 | YLTCVDISL | 98.267 | 287 |
| 263 | GLISFHVTL | 81.177 | 288 |
| 455 | VQPPVELFV | 65.934 | 289 |
| 498 | KLFQEKQKC | 64.336 | 290 |
| 589 | NMLVLGKHL | 57.085 | 291 |
| 109 | VLYLTCVDI | 56.754 | 292 |
| 25 | TLVDIYGSV | 55.607 | 293 |
| 460 | ELFVDWLAV | 32.811 | 294 |
| 289 | VVFRVAPWI | 31.581 | 295 |
| 536 | DLINYNKFV | 28.690 | 296 |
| 79 | VMNSPSNDL | 26.228 | 297 |
| 261 | PTGLISFHV | 25.773 | 298 |
| 285 | FTDTVVFRV | 23.711 | 299 |
| 470 | HVDEFLSFV | 16.312 | 300 |
| 234 | KVSYEVPRL | 15.047 | 301 |
| 487 | RMLLASPGA | 13.276 | 302 |
| 655 | FSFKWWNMV | 13.137 | 303 |
| 264 | LISFHVTLL | 11.485 | 304 |
| 107 | YAVLYLTCV | 10.220 | 305 |
| 356 | YVQAPHKTL | 8.598 | 306 |
| 200 | VLHTSSYDA | 8.446 | 307 |
| 579 | KATAFFPDL | 7.498 | 308 |
| 408 | GNLEVSPPV | 6.887 | 309 |
| 1 | MSLQRIVRV | 6.568 | 310 |
| 40 | FEVYGTPGV | 6.221 | 311 |
| 19 | CVAGVETLV | 6.086 | 312 |
| 104 | PLAYAVLYL | 5.945 | 313 |
| 591 | LVLGKHLGI | 5.742 | 314 |
| 467 | AVGHVDEFL | 5.038 | 315 |
| 163 | VQDNCDQHV | 4.795 | 316 |
| 174 | LQDLEDMSV | 4.795 | 317 |
| 459 | VELFVDWLA | 4.557 | 318 |
| 10 | SLEHPTSAV | 4.451 | 319 |
| 488 | MLLASPGAC | 4.062 | 320 |
| 144 | SGYGGILLV | 3.342 | 321 |
| 86 | DLNDSHVQI | 3.208 | 322 |
| 309 | YVCRVRNNT | 2.999 | 323 |
| 231 | GQDKVSYEV | 2.821 | 324 |
| 612 | CLEEKVRSL | 2.579 | 325 |
| 312 | RVRNNTCFV | 2.544 | 326 |

TABLE VII-continued

| Pos | 123456789 | Score | SeqID |
|---|---|---|---|
| 529 | NQVLSNKDL | 2.166 | 327 |
| 315 | NNTCFVDAV | 1.944 | 328 |
| 409 | NLEVSPPVV | 1.825 | 329 |
| 517 | VVDDEQVKT | 1.818 | 330 |
| 580 | ATAFFPDLV | 1.799 | 331 |
| 530 | QVLSNKDLI | 1.655 | 332 |
| 630 | FIDDFTPYH | 1.616 | 333 |
| 176 | DLEDMSVMV | 1.369 | 334 |
| 442 | VTQVVRDFL | 1.359 | 335 |
| 642 | GEVHCGTNV | 1.352 | 336 |
| 105 | LAYAVLYLT | 1.295 | 337 |
| 623 | PLGLHCTFI | 1.262 | 338 |
| 37 | TEMFEVYGT | 1.233 | 339 |
| 298 | MTPSTLPPL | 1.160 | 340 |
| 191 | AALPDDHKL | 1.098 | 341 |
| 132 | NFVDKRQWV | 1.089 | 342 |
| 376 | LOOPPYRRI | 1.079 | 343 |
| 437 | SSGRRVTQV | 1.044 | 344 |
| 15 | TSAVCVAGV | 1.044 | 345 |
| 653 | KPFSFKWWN | 0.987 | 346 |
| 72 | ATLEIIVVM | 0.987 | 347 |
| 358 | QAPHKTLPV | 0.966 | 348 |
| 179 | DMSVMVLRT | 0.928 | 349 |
| 281 | ASPIFTDTV | 0.845 | 350 |
| 9 | VSLEHPTSA | 0.836 | 351 |
| 117 | ISLDCDLNC | 0.836 | 352 |
| 584 | FPDLVNMLV | 0.835 | 353 |
| 444 | QVVRDFLHA | 0.826 | 354 |
| 491 | ASPGACFKL | 0.809 | 355 |
| 243 | HGDEERFFV | 0.808 | 356 |
| 44 | GTPGVDIYI | 0.797 | 357 |
| 558 | ELGLAECDI | 0.782 | 358 |
| 510 | RALLFQGVV | 0.724 | 359 |
| 17 | AVCVAGVET | 0.652 | 360 |
| 583 | FPPDLVNML | 0.644 | 361 |
| 21 | AGVRTLVDI | 0.642 | 362 |
| 184 | VLRTQGPAA | 0.642 | 363 |
| 621 | LEPLGLHCT | 0.567 | 364 |
| 221 | DVCEAYRHV | 0.561 | 365 |
| 616 | KVRSLLEPL | 0.560 | 366 |
| 620 | LLEPLGLHC | 0.541 | 367 |
| 385 | LGPDFGYVT | 0.528 | 368 |
| 402 | SGLDSPGNL | 0.523 | 369 |
| 553 | EVLKRELGL | 0.519 | 370 |
| 618 | RSLLEPLGL | 0.516 | 371 |
| 417 | VANGKEYPL | 0.504 | 372 |
| 505 | KCGHGRALL | 0.488 | 373 |
| 256 | PPDAGFTGL | 0.488 | 374 |
| 638 | HMLHGEVHC | 0.451 | 375 |
| 359 | APHKTLPVV | 0.428 | 376 |
| 524 | KTISINQVL | 0.426 | 377 |
| 463 | VDWLAVGHV | 0.408 | 378 |
| 294 | APWIMTPST | 0.404 | 379 |
| 34 | PEGTEMFEV | 0.397 | 380 |
| 319 | FVDAVAELA | 0.392 | 381 |
| 421 | KEYPLGRIL | 0.381 | 382 |
| 523 | VKTISINQV | 0.378 | 383 |
| | v.2-A2-9mers: 184P1E2 | | |
| 7 | TLAPLEVYV | 382.536 | 384 |
| 1 | WIMTPSTLA | 11.626 | 385 |
| 3 | MTPSTLAPL | 1.160 | 386 |
| 8 | LAPLEVYVC | 0.111 | 387 |
| 2 | IMTPSTLAP | 0.018 | 388 |
| 5 | PSTLAPLEV | 0.010 | 389 |
| 9 | APLEVYVCR | 0.002 | 390 |
| 6 | STLAPLEVY | 0.002 | 391 |
| 4 | TPSTLAPLE | 0.000 | 392 |
| | v.3-A2-9mers: 184P1E2 | | |
| 1 | DEFLSFVPV | 0.713 | 393 |
| 9 | VPDGKGFRM | 0.128 | 394 |
| 3 | FLSFVPVPD | 0.069 | 395 |
| 4 | LSPVPVPDG | 0.007 | 396 |
| 6 | FVPVPDGKG | 0.004 | 397 |
| 7 | VPVPDGKGF | 0.001 | 398 |
| 8 | PVPDGKGFR | 0.000 | 399 |

TABLE VII-continued

| Pos | 123456789 | Score | SeqID |
|---|---|---|---|
| 2 | EPLSFVPVP | 0.000 | 400 |
| 5 | SFVPVDGK | 0.000 | 401 |

TABLE VIII

| Pos | 1234567890 | Score | SeqID |
|---|---|---|---|
| | v.1-A2-10mers: 184P1E2 | | |
| 173 | CLQDLEDMSV | 285.163 | 402 |
| 192 | ALFDDHKLVL | 132.868 | 403 |
| 454 | KVQPPVELFV | 117.152 | 404 |
| 560 | GLAECDIIDI | 98.381 | 405 |
| 619 | SLLEPLGLHC | 75.365 | 406 |
| 297 | IMTPSTLPPL | 60.325 | 407 |
| 263 | GLISFHVTLL | 49.134 | 408 |
| 383 | RILGPDFGYV | 48.070 | 409 |
| 348 | IQDEMELGYV | 32.332 | 410 |
| 403 | GLDSFGNLEV | 27.821 | 411 |
| 2 | SLQRIVRVSL | 21.362 | 412 |
| 384 | ILGPDFGYVT | 19.737 | 413 |
| 301 | STLPPLEVYV | 19.658 | 414 |
| 571 | QLFKTERKKA | 18.382 | 415 |
| 590 | MLVLCKXLCI | 17.736 | 416 |
| 514 | FQGVVDDEQV | 15.895 | 417 |
| 459 | VELFVDWLAV | 14.461 | 418 |
| 433 | NLPGSSGRRV | 13.910 | 419 |
| 639 | MLHGEVHCGT | 12.668 | 420 |
| 357 | VQAPHKTLPV | 11.988 | 421 |
| 78 | VVMNSPSNDL | 11.757 | 422 |
| 9 | VSLEHPTSAV | 11.709 | 423 |
| 103 | LPLAYAVLYL | 11.096 | 424 |
| 242 | LHGDEERFFV | 10.739 | 425 |
| 469 | GHVDEFLSFV | 9.519 | 426 |
| 566 | IIDIPQLFKT | 9.295 | 427 |
| 131 | RNFVDKRQWV | 9.239 | 428 |
| 289 | VVFRVAPWIM | 8.408 | 429 |
| 125 | CEGRQDRNPV | 7.438 | 430 |
| 535 | KDLINYNKFV | 6.880 | 431 |
| 579 | KATAFFPDLV | 6.295 | 432 |
| 204 | SSYDAKRAQV | 5.957 | 433 |
| 517 | VVDDEQVKTI | 5.854 | 434 |
| 612 | CLEEKVRSLL | 5.605 | 435 |
| 653 | KPFSFKWWNM | 5.355 | 436 |
| 253 | GLSFPDAGFT | 5.328 | 437 |
| 630 | PIDDFTPYHM | 5.153 | 438 |
| 441 | RVTQVVRDFL | 5.038 | 439 |
| 288 | TVVFRVAPWI | 5.021 | 440 |
| 375 | ELQDFPYKRI | 4.812 | 441 |
| 302 | TLPPLEVYVC | 4.685 | 442 |
| 284 | IFTDTVVFRV | 4.491 | 443 |
| 191 | AALFDDHKLV | 3.574 | 444 |
| 108 | AVLYLTCVDI | 3.378 | 445 |
| 462 | FVDWLAVGHV | 3.348 | 446 |
| 416 | VVANGKEYPL | 3.178 | 447 |
| 230 | LGQDKVSYEV | 3.165 | 448 |
| 490 | LASPGACFKL | 2.925 | 449 |
| 408 | GNLEVSPPVV | 2.824 | 450 |
| 184 | VLRTQGPAAL | 2.760 | 451 |
| 183 | MVLRTQGPAA | 2.734 | 452 |
| 199 | LVLHTSSYDA | 2.734 | 453 |
| 516 | GVVDDEQVKT | 2.673 | 454 |
| 11 | LEHPTSAVCV | 2.299 | 455 |
| 421 | KEYPLGRILI | 2.272 | 456 |
| 598 | GIPKPFGPII | 2.235 | 457 |
| 17 | AVCVAGVETL | 2.107 | 458 |
| 407 | FGNLEVSPPV | 2.088 | 459 |
| 309 | YVCRVNNTC | 2.000 | 460 |
| 262 | TGLISFHVTL | 1.961 | 461 |
| 314 | RNNTCFVDAV | 1.944 | 462 |
| 162 | DVQDNCDQHV | 1.871 | 463 |
| 620 | LLEPLGLHCT | 1.865 | 464 |
| 280 | SASPIFTDTV | 1.799 | 465 |
| 487 | RNLLASPGAC | 1.726 | 466 |

TABLE VIII-continued

| Pos | 1234567890 | Score | SeqID |
|---|---|---|---|
| 43 | YGTPGVDIYI | 1.723 | 467 |
| 325 | ELARKAGCKL | 1.602 | 468 |
| 538 | INYNKFVQSC | 1.542 | 469 |
| 175 | QDLEDMSVMV | 1.465 | 470 |
| 466 | LAVGHVDEFL | 1.359 | 471 |
| 317 | TCFVDAVAEL | 1.187 | 472 |
| 294 | APWIMTPSTL | 1.157 | 473 |
| 436 | GSSGRRVTQV | 1.044 | 474 |
| 611 | CCLEEKVRSL | 0.973 | 475 |
| 601 | KPEGPIINGC | 0.966 | 476 |
| 498 | KLFQEKQKCG | 0.965 | 477 |
| 443 | TQVVRDFLHA | 0.957 | 478 |
| 583 | FFPDLVNMLV | 0.911 | 479 |
| 358 | QAPHKTLPVV | 0.911 | 480 |
| 588 | VNMLVLGKHL | 0.877 | 481 |
| 182 | VMVLRTQGPA | 0.793 | 482 |
| 18 | VCVAGVETLV | 0.772 | 483 |
| 557 | RELGLAECDI | 0.751 | 484 |
| 578 | KKATAPFPDL | 0.750 | 485 |
| 114 | CVDISLDCDL | 0.748 | 486 |
| 33 | VPEGTEMFEV | 0.659 | 487 |
| 581 | TAPFPDLVNM | 0.587 | 488 |
| 20 | VAGVETLVDI | 0.567 | 489 |
| 105 | LAYAVLYLTC | 0.563 | 490 |
| 271 | LLDDSNEDFS | 0.560 | 491 |
| 270 | TLLDDSNEDF | 0.554 | 492 |
| 529 | NQVLSNKDLI | 0.518 | 493 |
| 522 | QVKTISINQV | 0.490 | 494 |
| 488 | MLLASPGACF | 0.469 | 495 |
| 299 | TPSTLPPLEV | 0.454 | 496 |
| 8 | RVSLEHPTSA | 0.435 | 497 |
| 279 | FSASPIFTDT | 0.425 | 498 |
| 70 | FDATLEIIVV | 0.419 | 499 |
| 552 | REVLKRELGL | 0.415 | 500 |
| 176 | DLEDMSVMVL | 0.396 | 501 |
| | v.2-A2-10mers: 184P1E2 | | |
| 3 | IMTPSTLAPL | 60.325 | 502 |
| 7 | STLAPLEVYV | 19.658 | 503 |
| 10 | APLEVYVCRV | 15.841 | 504 |
| 8 | TLAPLEVYVC | 4.685 | 505 |
| 5 | TPSTLAPLEV | 0.454 | 506 |
| 2 | WIMTPSTLAP | 0.035 | 507 |
| 9 | LAPLEVYVCR | 0.001 | 508 |
| 4 | MTPSTLAPLE | 0.000 | 509 |
| 1 | PWIMTPSTLA | 0.000 | 510 |
| 6 | PSTLAPLEVY | 0.000 | 511 |
| | v.3-A2-10mers: 184P1E2 | | |
| 4 | FLSFVPVPDG | 0.788 | 512 |
| 9 | PVPDGKGFRM | 0.227 | 513 |
| 10 | VPDGKGFRML | 0.036 | 514 |
| 7 | FVPVPDGKGF | 0.030 | 515 |
| 1 | VDEFLSFVPV | 0.020 | 516 |
| 5 | LSFVPVPDGK | 0.000 | 517 |
| 2 | DEFLSFVPVP | 0.000 | 518 |
| 8 | VPVPDGKGFR | 0.000 | 519 |
| 6 | SFVPVPDGKG | 0.000 | 520 |
| 3 | EFLSFVPVPO | 0.000 | 521 |

TABLE IX

| Pos | 123456789 | Score | SeqID |
|---|---|---|---|
| | v.1-A3-9mers 184P1E2 | | |
| 198 | KLVLHTSSY | 18.000 | 522 |
| 587 | LVNMLVLGK | 12.000 | 523 |
| 375 | ELQDFPYKR | 10.800 | 524 |
| 571 | QLFKTERKK | 10.000 | 525 |
| 516 | GVVDDEQVK | 9.000 | 526 |
| 253 | GLSFPDAGF | 9.000 | 527 |
| 263 | GLISFHVTL | 8.100 | 528 |
| 566 | IIDIPQLFK | 6.000 | 529 |

TABLE IX-continued

| Pos | 123456789 | Score | SeqID |
|---|---|---|---|
| 527 | SINQVLSNK | 4.500 | 530 |
| 383 | RILGPDFGY | 4.050 | 531 |
| 454 | KVQPPVELF | 4.050 | 532 |
| 229 | VLGQDKVSY | 4.000 | 533 |
| 22 | GVETLVDIY | 3.600 | 534 |
| 495 | ACPKLFQEK | 3.000 | 535 |
| 498 | KLFQEKQKC | 3.000 | 536 |
| 241 | RLHGDEERF | 3.000 | 537 |
| 489 | LLASPGACF | 3.000 | 538 |
| 109 | VLYLTCVDI | 3.000 | 539 |
| 148 | GILLVNCDR | 2.700 | 540 |
| 271 | LLDDSNEDF | 2.000 | 541 |
| 433 | NLPGSSGRR | 1.800 | 542 |
| 111 | YLTCVDISL | 1.800 | 543 |
| 128 | RQDRNFVDK | 1.800 | 544 |
| 325 | ELARKAGCK | 1.800 | 545 |
| 301 | STLPPLEVY | 1.012 | 546 |
| 79 | VMNSPSNDL | 0.900 | 547 |
| 650 | VCRKPFSFK | 0.900 | 548 |
| 374 | GELQDFPYK | 0.810 | 549 |
| 645 | HCGTNVCRK | 0.600 | 550 |
| 620 | LLEPLGLHC | 0.600 | 551 |
| 200 | VLHTSSYDA | 0.600 | 552 |
| 335 | TICPQAENR | 0.600 | 553 |
| 649 | NVCRKPFSF | 0.600 | 554 |
| 460 | ELFVDWLAV | 0.600 | 555 |
| 202 | HTSSYDAKR | 0.600 | 556 |
| 544 | VQSCIDWNR | 0.540 | 557 |
| 234 | KVSYEVPRL | 0.540 | 558 |
| 192 | ALPDDHKLV | 0.500 | 559 |
| 289 | VVFRVAPWI | 0.450 | 560 |
| 589 | NMLVLGKHL | 0.450 | 561 |
| 44 | GTPGVDIYI | 0.405 | 562 |
| 625 | GLHCTFIDD | 0.360 | 563 |
| 348 | IQDEMELGY | 0.360 | 564 |
| 104 | PLAYAVLYL | 0.360 | 565 |
| 619 | SLLEPLGLH | 0.304 | 566 |
| 10 | SLEHPTSAV | 0.300 | 567 |
| 302 | TLPPLEVYV | 0.300 | 568 |
| 490 | LASPGACFK | 0.300 | 569 |
| 512 | LLFQGVVDD | 0.300 | 570 |
| 487 | RMLLASPGA | 0.300 | 571 |
| 638 | HMLHGEVHC | 0.300 | 572 |
| 32 | SVPEGTEMF | 0.300 | 573 |
| 413 | SPPVVANGK | 0.300 | 574 |
| 384 | ILGPDFGYV | 0.270 | 575 |
| 612 | CLEEKVRSL | 0.270 | 576 |
| 616 | KVRSLLEPL | 0.270 | 577 |
| 591 | LVLGKHLGI | 0.270 | 578 |
| 598 | GIPKPFGPI | 0.243 | 579 |
| 186 | RTQGPAALF | 0.225 | 580 |
| 524 | KTISINQVL | 0.203 | 581 |
| 184 | VLRTQGPAA | 0.200 | 582 |
| 409 | NLEVSPPVV | 0.200 | 583 |
| 55 | NMERGRERA | 0.200 | 584 |
| 362 | KTLPVVFDS | 0.182 | 585 |
| 103 | LPLAYAVLY | 0.180 | 586 |
| 558 | ELGLAECDI | 0.180 | 587 |
| 444 | QVVRDFLHA | 0.180 | 588 |
| 218 | GPEDVCEAY | 0.180 | 589 |
| 264 | LISFHVTLL | 0.180 | 590 |
| 86 | DLNDSHVQI | 0.180 | 591 |
| 179 | DMSVMVLRT | 0.180 | 592 |
| 305 | PLEVYVCRV | 0.180 | 593 |
| 560 | GLAECDIID | 0.180 | 594 |
| 364 | LPVVFDSPR | 0.180 | 595 |
| 403 | GLDSFGNLE | 0.180 | 596 |
| 579 | KATAFFPDL | 0.162 | 597 |
| 647 | GTNVCRKPF | 0.150 | 598 |
| 470 | HVDEFLSFV | 0.135 | 599 |
| 536 | DLINYNKFV | 0.135 | 600 |
| 25 | TLVDIYGSV | 0.135 | 601 |
| 565 | DIIDIPQLF | 0.135 | 602 |
| 321 | DAVAELARK | 0.135 | 603 |
| 285 | FTDTVVFRV | 0.135 | 604 |
| 466 | LAVGHVDEF | 0.135 | 605 |
| 386 | GPDFGYVTR | 0.120 | 606 |

TABLE IX-continued

| Pos | 123456789 | Score | SeqID |
|---|---|---|---|
| 569 | IPQLFKTER | 0.120 | 607 |
| 354 | LGYVQAPHK | 0.100 | 608 |
| 548 | IDWNREVLK | 0.100 | 609 |
| 283 | PIPTDTVVF | 0.100 | 610 |
| 570 | PQLFKTERK | 0.090 | 611 |
| 534 | NKDLINYNK | 0.090 | 612 |
| 428 | ILIGGNLPG | 0.090 | 613 |
| 288 | TVVFRVAPW | 0.090 | 614 |
| 363 | TLPVVFDSP | 0.090 | 615 |
| 467 | AVGHVDEFL | 0.090 | 616 |
| 353 | ELGYVQAPH | 0.090 | 617 |
| 441 | RVTQVVRDF | 0.090 | 618 |
| 5 | RIVRVSLEH | 0.090 | 619 |
| 530 | QVLSNKDLI | 0.090 | 620 |
| 554 | VLKRELGLA | 0.090 | 621 | v.2-A3-9mers: 184P1E2

| | | | |
|---|---|---|---|
| 6 | STLAPLEVY | 0.675 | 622 |
| 7 | TLAPLEVYV | 0.300 | 623 |
| 9 | APLEVYVCR | 0.135 | 624 |
| 2 | IMTPSTLAP | 0.060 | 625 |
| 1 | WIMTPSTLA | 0.045 | 626 |
| 3 | MTPSTLAPL | 0.045 | 627 |
| 8 | LAPLEVYVC | 0.018 | 628 |
| 4 | TPSTLAPLE | 0.000 | 629 |
| 5 | PSTLAPLEV | 0.000 | 630 | v.3-A3-9mers-184P1E2

| | | | |
|---|---|---|---|
| 5 | SFVPVPDGK | 0.068 | 631 |
| 3 | FLSPVPVPD | 0.030 | 632 |
| 7 | VPVPDGKGF | 0.022 | 633 |
| 8 | PVPDGKGFR | 0.012 | 634 |
| 9 | VPDGKGPRM | 0.009 | 635 |
| 1 | DEFLSFVPV | 0.003 | 636 |
| 4 | LSFVPVPDG | 0.002 | 637 |
| 6 | FVPVPDGKG | 0.001 | 638 |
| 2 | EFLSFVPVP | 0.000 | 639 |

TABLE X

| Pos | 1234567890 | Score | SeqID |
|---|---|---|---| v.1-A3-10mers: 184P1E2

| | | | |
|---|---|---|---|
| 586 | DLVNMLVLGK | 54.000 | 640 |
| 592 | VLGKHLGIPK | 40.000 | 641 |
| 625 | GLHCTFIDDF | 27.000 | 642 |
| 489 | LLASPGACFK | 20.000 | 643 |
| 200 | VLHTSSYDAK | 20.000 | 644 |
| 363 | TLPVVFDSPR | 12.000 | 645 |
| 531 | VLSNKDLINY | 12.000 | 646 |
| 649 | NVCRKPFSFK | 9.000 | 647 |
| 560 | GLAECDIIDI | 8.100 | 648 |
| 263 | GLISFHVTLL | 8.100 | 649 |
| 192 | ALFDDHKLVL | 6.000 | 650 |
| 465 | WLAVGNVDEF | 6.000 | 651 |
| 353 | ELGYVQAPHK | 6.000 | 652 |
| 488 | MLLASPGACP | 4.500 | 653 |
| 270 | TLLDDSNEDF | 3.000 | 654 |
| 628 | CTFIODFTPY | 3.000 | 655 |
| 565 | DIIDIPQLFK | 2.700 | 656 |
| 302 | TLPPLEVYVC | 2.700 | 657 |
| 445 | VVRDFLHAQK | 2.000 | 658 |
| 547 | CIDWNREVLK | 2.000 | 659 |
| 590 | MLVLGKHLGI | 1.800 | 660 |
| 189 | GPAALFDDHK | 1.800 | 661 |
| 49 | DIYISPNMER | 1.800 | 662 |
| 494 | GACFKLFQEK | 1.800 | 663 |
| 543 | FVQSCIDWNR | 1.800 | 664 |
| 612 | CLEEKVRSLL | 1.350 | 665 |
| 297 | IMTPSTLPPL | 1.350 | 666 |
| 384 | ILGPDFGYVT | 1.350 | 667 |
| 122 | DLNCEGRQDR | 1.200 | 668 |
| 102 | PLPLAYAVLY | 1.200 | 669 |

TABLE X-continued

| Pos | 1234567890 | Score | SeqID |
|---|---|---|---|
| 403 | GLDSFGNLEV | 1.200 | 670 |
| 176 | DLEDMSVMVL | 1.080 | 671 |
| 128 | RQDRNFVDKR | 1.080 | 672 |
| 619 | SLLEPLGLHC | 0.900 | 673 |
| 228 | HVLGQDKVSY | 0.900 | 674 |
| 2 | SLQRIVRVSL | 0.900 | 675 |
| 347 | WIQDEMELGY | 0.800 | 676 |
| 319 | PVDAVAELAR | 0.800 | 677 |
| 184 | VLRTQGPAAL | 0.600 | 678 |
| 283 | PIFTDTVVFR | 0.600 | 679 |
| 109 | VLYLTCVDIS | 0.600 | 680 |
| 137 | RQWVWGPSGY | 0.600 | 681 |
| 598 | GIPKPFGPII | 0.540 | 682 |
| 475 | LSPVPAPDGK | 0.500 | 683 |
| 571 | QLFKTERKKA | 0.500 | 684 |
| 374 | GELQDFPYKR | 0.486 | 685 |
| 512 | LLFQGVVDDE | 0.450 | 686 |
| 173 | CLQDLEDMSV | 0.400 | 687 |
| 568 | DIPQLFKTER | 0.360 | 688 |
| 73 | TLEIIVVMNS | 0.360 | 689 |
| 526 | ISINQVLSNK | 0.338 | 690 |
| 289 | VVFRVAPWIM | 0.300 | 691 |
| 241 | RLHGDEERFF | 0.300 | 692 |
| 334 | LTICPQAENR | 0.300 | 693 |
| 574 | KTERKKATAF | 0.300 | 694 |
| 409 | NLEVSPPVVA | 0.300 | 695 |
| 454 | KVQPPVELFV | 0.270 | 696 |
| 639 | MLHGEVHCGT | 0.225 | 697 |
| 412 | VSPPVVANGK | 0.225 | 698 |
| 620 | LLEPLGLXCT | 0.225 | 699 |
| 41 | EVYGTPGVDI | 0.203 | 700 |
| 569 | IPQLFKTERK | 0.200 | 701 |
| 10 | SLEHPTSAVC | 0.200 | 702 |
| 127 | GRQDRNFVDK | 0.180 | 703 |
| 533 | SMKDLINYNK | 0.180 | 704 |
| 558 | ELGLAECDII | 0.180 | 705 |
| 325 | ELARKAGCKL | 0.180 | 706 |
| 416 | VVANGKEYPL | 0.180 | 707 |
| 17 | AVCVAGVETL | 0.180 | 708 |
| 498 | KLFQEKQKCG | 0.150 | 709 |
| 460 | ELFVDWLAVG | 0.135 | 710 |
| 38 | EMFEVYGTPG | 0.135 | 711 |
| 375 | ELQDFPYKRI | 0.135 | 712 |
| 36 | GTEMFEVYGT | 0.135 | 713 |
| 78 | VVMNSPSNDL | 0.135 | 714 |
| 288 | TVVFRVAPWI | 0.135 | 715 |
| 428 | ILIGGNLPGS | 0.135 | 716 |
| 548 | IDWNREVLKR | 0.120 | 717 |
| 218 | GPEDVCEAYR | 0.120 | 718 |
| 643 | EVHCGTNVCR | 0.120 | 719 |
| 505 | KCGHGRALLF | 0.120 | 720 |
| 601 | KPFGPIINGC | 0.101 | 721 |
| 477 | FVPAPDGKGF | 0.100 | 722 |
| 644 | VHCGTNVCRK | 0.090 | 723 |
| 333 | KLTICPQAEN | 0.090 | 724 |
| 47 | GVDIYISPNM | 0.090 | 725 |
| 517 | VVDDEQVKTI | 0.090 | 726 |
| 653 | KPFSFKWWNM | 0.090 | 727 |
| 182 | VMVLRTQGPA | 0.090 | 728 |
| 317 | TCFVDAVAEL | 0.090 | 729 |
| 25 | TLVDIYGSVP | 0.090 | 730 |
| 198 | KLVLHTSSYD | 0.090 | 731 |
| 441 | RVTQVVRDPL | 0.090 | 732 |
| 487 | RMLLASPGAC | 0.090 | 733 |
| 250 | FVEGLSFPDA | 0.090 | 734 |
| 199 | LVLHTSSYDA | 0.090 | 735 |
| 511 | ALLFQGVVDD | 0.090 | 736 |
| 253 | GLSFPDAGFT | 0.090 | 737 |
| 108 | AVLYLTCVDI | 0.090 | 738 |
| 638 | HMLHGEVHCG | 0.090 | 739 |
| v.2-A3-10mers: 184P1E2 | | | |
| 8 | TLAPLEVYVC | 2.700 | 740 |
| 3 | IMTPSTLAPL | 1.350 | 741 |
| 9 | LAPLEVYCR | 0.060 | 742 |
| 10 | APLEVYVCRV | 0.041 | 743 |
| 7 | STLAPLEVYV | 0.015 | 744 |

TABLE X-continued

| Pos | 1234567890 | Score | SeqID |
|---|---|---|---|
| 2 | WIMTPSTLAP | 0.006 | 745 |
| 6 | PSTLAPLEVY | 0.005 | 746 |
| 5 | TPSTLAPLEV | 0.004 | 747 |
| 4 | MTPSTLAPLE | 0.001 | 748 |
| 1 | PWIMTPSTLA | 0.000 | 749 |
| v.3-A3-10mers: 184P1E2 | | | |
| 5 | LSFVPVPDGK | 0.750 | 750 |
| 7 | FVPVPDGKGF | 0.100 | 751 |
| 4 | FLSFVPVPDG | 0.090 | 752 |
| 8 | VPVPDGKGFR | 0.027 | 753 |
| 9 | PVPDGKGFRM | 0.006 | 754 |
| 10 | VPDGKGFRML | 0.003 | 755 |
| 2 | DEELSFVPVP | 0.001 | 756 |
| 1 | VDEFLSFVPV | 0.001 | 757 |
| 6 | SFVPVPDGKG | 0.000 | 758 |
| 3 | EFLSFVPVPD | 0.000 | 759 |

TABLE XI

| Pos | 123456789 | Score | SeqID |
|---|---|---|---|
| v.1-A11-9mers: 184P1E2 | | | |
| 516 | GVVDDEQVK | 9.000 | 760 |
| 587 | LVNMLVLGK | 4.000 | 761 |
| 128 | RQDRNFVDK | 1.800 | 762 |
| 566 | IIDIPQLFK | 0.800 | 763 |
| 495 | ACFKLPQEK | 0.400 | 764 |
| 527 | SINQVLSNK | 0.400 | 765 |
| 148 | GILLVNCDR | 0.360 | 766 |
| 476 | SFVPAPDGK | 0.300 | 767 |
| 374 | GELQDFPYK | 0.270 | 768 |
| 50 | IYISPNMER | 0.240 | 769 |
| 544 | VQSCIDWNR | 0.240 | 770 |
| 202 | HTSSYDAKR | 0.200 | 771 |
| 490 | LASPGACFK | 0.200 | 772 |
| 645 | HCGTNVCRK | 0.200 | 773 |
| 650 | VCRKPFSFK | 0.200 | 774 |
| 413 | SPPVVANGK | 0.200 | 775 |
| 325 | ELARKAGCK | 0.120 | 776 |
| 386 | GPDFGYVTP | 0.120 | 777 |
| 570 | PQLFKTERK | 0.090 | 778 |
| 321 | DAVAELARK | 0.090 | 779 |
| 571 | QLFKTERKK | 0.080 | 780 |
| 335 | TICPQAENR | 0.080 | 781 |
| 433 | NLPGSSGRR | 0.080 | 782 |
| 22 | GVETLVDIY | 0.060 | 783 |
| 312 | RVRNNTCFV | 0.060 | 784 |
| 649 | WVCRKPFSF | 0.060 | 785 |
| 444 | QVVRDFLHA | 0.060 | 786 |
| 616 | KVRSLLEPL | 0.060 | 787 |
| 364 | LPVVFDSPR | 0.060 | 788 |
| 44 | GTPGVDIYI | 0.060 | 789 |
| 454 | KVQPPVELF | 0.060 | 790 |
| 591 | LVLGKHLGI | 0.060 | 791 |
| 234 | KVSYEVPRL | 0.060 | 792 |
| 383 | RILGPDFGY | 0.054 | 793 |
| 375 | ELQDFPYKR | 0.048 | 794 |
| 524 | KTISINQVL | 0.045 | 795 |
| 354 | LGYVQAPHK | 0.040 | 796 |
| 284 | IFTDTVVFR | 0.040 | 797 |
| 391 | YVTREPRDR | 0.040 | 798 |
| 289 | VVFRVAPWI | 0.040 | 799 |
| 593 | LGKHLGIPK | 0.040 | 800 |
| 133 | PVDKRQWVW | 0.040 | 801 |
| 548 | IDWNREVLK | 0.040 | 802 |
| 569 | IPQLFKTER | 0.040 | 803 |
| 534 | NKDLINYNK | 0.040 | 804 |
| 432 | GNLPGSSGR | 0.036 | 805 |
| 231 | GQDKVSYEV | 0.036 | 806 |
| 5 | RIVRVSLEH | 0.036 | 807 |
| 288 | TVVFRVAPW | 0.030 | 808 |
| 530 | QVLSNKDLI | 0.030 | 809 |

TABLE XI-continued

| Pos | 123456789 | Score | SeqID |
|---|---|---|---|
| 285 | FTDTVVFRV | 0.030 | 810 |
| 183 | MVLRTQGPA | 0.030 | 811 |
| 186 | RTQGPAALF | 0.030 | 812 |
| 574 | KTERKKATA | 0.030 | 813 |
| 261 | FTGLISFHV | 0.030 | 814 |
| 443 | TQVVRDFLH | 0.027 | 815 |
| 248 | RFFVEGLSF | 0.024 | 816 |
| 201 | LHTSSYDAK | 0.020 | 817 |
| 462 | FVDWLAVGH | 0.020 | 818 |
| 467 | AVGHVDEFL | 0.020 | 819 |
| 319 | FVDAVAELA | 0.020 | 820 |
| 226 | YRHVLGQDK | 0.020 | 821 |
| 32 | SVPEGTEMF | 0.020 | 822 |
| 19 | CVAGVETLV | 0.020 | 823 |
| 470 | HVDEFLSFV | 0.020 | 824 |
| 610 | CCCLEEKVR | 0.020 | 825 |
| 446 | VRDFLHAQK | 0.020 | 826 |
| 608 | NGCCCLEEK | 0.020 | 827 |
| 190 | PAALPDDHK | 0.020 | 828 |
| 503 | KQKCGHGRA | 0.018 | 829 |
| 487 | RMLLASPGA | 0.018 | 830 |
| 263 | GLISFHVTL | 0.018 | 831 |
| 198 | KLVLHTSSY | 0.018 | 832 |
| 542 | KFVQSCIDW | 0.018 | 833 |
| 553 | EVLKRELGL | 0.018 | 834 |
| 497 | FKLFQEKQK | 0.015 | 835 |
| 647 | GTNVCRKPF | 0.015 | 836 |
| 301 | STLPPLEVY | 0.015 | 837 |
| 72 | ATLEIIVVM | 0.015 | 838 |
| 362 | KTLPVVFDS | 0.013 | 839 |
| 59 | GRERADTRR | 0.012 | 840 |
| 338 | PQAENRNDR | 0.012 | 841 |
| 58 | RGRERADTR | 0.012 | 842 |
| 439 | GRRVTQVVR | 0.012 | 843 |
| 348 | IQDEMELGY | 0.012 | 844 |
| 120 | DCDLNCEGR | 0.012 | 845 |
| 241 | RLHGDEERF | 0.012 | 846 |
| 598 | GIPKPFGPI | 0.012 | 847 |
| 62 | RADTRRWRF | 0.012 | 848 |
| 174 | LQDLEDMSV | 0.012 | 849 |
| 292 | RVAPWIMTP | 0.012 | 850 |
| 253 | GLSFPDAGF | 0.012 | 851 |
| 455 | VQPPVELFV | 0.012 | 852 |
| 298 | MTPSTLPPL | 0.010 | 853 |
| 580 | ATAFFPDLV | 0.010 | 854 |
| 316 | NTCFVDAVA | 0.010 | 855 |
| 356 | YVQAPHKTL | 0.010 | 856 |
| 442 | VTQVVRDFL | 0.010 | 857 |
| 510 | RALLPQGVV | 0.009 | 858 |
| 64 | DTRRWRFDA | 0.009 | 859 |
| v.2-A11-9mers: 184P1E2 | | | |
| 9 | APLEVYVCR | 0.060 | 860 |
| 6 | STLAPLEVY | 0.015861 | |
| 3 | MTPSTLAPL | 0.010862 | |
| 1 | WIMTPSTLA | 0.008863 | |
| 7 | TLAPLEVYV | 0.004864 | |
| 2 | IMTPSTLAP | 0.001865 | |
| 8 | LAPLEVYVC | 0.000866 | |
| 4 | TPSTLAPLE | 0.000867 | |
| 5 | PSTLAPLEV | 0.000868 | |
| v.3-A11-9mers: 184P1E2 | | | |
| 5 | SFVPVPDGK | 0.300 | 869 |
| 8 | PVPDGKGFR | 0.040 | 870 |
| 9 | VPDGKGFRM | 0.006 | 871 |
| 6 | FVPVPDGKG | 0.002 | 872 |
| 7 | VPVPDGKGF | 0.002 | 873 |
| 3 | FLSFVPVPD | 0.000 | 874 |
| 1 | DEFLSFVPV | 0.000 | 875 |
| 2 | EFLSFVPVP | 0.000 | 876 |
| 4 | LSFVPVPDG | 0.000 | 877 |

TABLE XII

| Pos | 1234567890 | Score | SeqID |
|---|---|---|---|
| v.1-A11-10mers: 184P1E2 | | | |
| 445 | VVRDFLHAQK | 2.000 | 878 |
| 649 | NVCRKPFSFK | 2.000 | 879 |
| 592 | VLGKHLGIPK | 0.800 | 880 |
| 543 | FVQSCIDWNR | 0.800 | 881 |
| 319 | EVDAVAELAR | 0.800 | 882 |
| 189 | GPAALFDDHK | 0.600 | 883 |
| 494 | GACFKLFQEK | 0.600 | 884 |
| 200 | VLMTSSYDAK | 0.400 | 885 |
| 489 | LLASPGACFK | 0.400 | 886 |
| 225 | AYRHVLGQDK | 0.400 | 887 |
| 547 | CIDWNREVLK | 0.400 | 888 |
| 128 | RQDRNFVDKR | 0.360 | 889 |
| 565 | DIIDIPQLFK | 0.360 | 890 |
| 586 | DLVNMLVLGK | 0.360 | 891 |
| 334 | LTICPQAENR | 0.300 | 892 |
| 569 | IPQLFKTERK | 0.200 | 893 |
| 218 | GPEDVCEAYP | 0.120 | 894 |
| 454 | KVQPPVELFV | 0.120 | 895 |
| 643 | EVHCGTNVCR | 0.120 | 896 |
| 353 | ELGYVQAPHK | 0.120 | 897 |
| 374 | GELQDFPYKR | 0.108 | 898 |
| 496 | CFKLFQEKQK | 0.100 | 899 |
| 49 | DIYISPNMER | 0.096 | 900 |
| 324 | AELARKAGCK | 0.090 | 901 |
| 363 | TLPVVFDSPR | 0.080 | 902 |
| 289 | VVFRVAPWIM | 0.080 | 903 |
| 533 | SNKDLINYNK | 0.080 | 904 |
| 127 | GRQDRNFVDK | 0.060 | 905 |
| 609 | GCCCLEEKVR | 0.060 | 906 |
| 441 | RVTQVVRDFL | 0.060 | 907 |
| 199 | LVLHTSSYDA | 0.060 | 908 |
| 8 | RVSLEHPTSA | 0.060 | 909 |
| 47 | GVDIYISPNM | 0.060 | 910 |
| 78 | VVMNSPSNDL | 0.040 | 911 |
| 478 | VPAPDGKGFR | 0.040 | 912 |
| 416 | VVANGKEYPL | 0.040 | 913 |
| 337 | CPQAENPNDR | 0.040 | 914 |
| 607 | INGCCCLEEK | 0.040 | 915 |
| 239 | VPRLHGDEER | 0.040 | 916 |
| 303 | LPPLEVYVCR | 0.040 | 917 |
| 475 | LSFVPAPDGK | 0.040 | 918 |
| 432 | GNLPGSSGRR | 0.036 | 919 |
| 390 | GYVTREPRDR | 0.036 | 920 |
| 137 | RQWVWGPSGY | 0.036 | 921 |
| 526 | ISINQVLSNK | 0.030 | 922 |
| 515 | QGVVDDEQVK | 0.030 | 923 |
| 228 | HVLGQDKVSY | 0.030 | 924 |
| 108 | AVLYLTCVDI | 0.030 | 925 |
| 442 | VTQVVRDFLH | 0.030 | 926 |
| 574 | KTERKKATAF | 0.030 | 927 |
| 288 | TVVFRVAPWI | 0.030 | 928 |
| 183 | MVLRTQGPAA | 0.030 | 929 |
| 568 | DIPQLFKTER | 0.024 | 930 |
| 653 | KPFSFKWWNM | 0.024 | 931 |
| 122 | DLNCEGRQDR | 0.024 | 932 |
| 560 | GLAECDIIDI | 0.024 | 933 |
| 403 | GLDSFGNLEV | 0.024 | 934 |
| 628 | CTFIDDFTPY | 0.020 | 935 |
| 522 | QVKTISINQV | 0.020 | 936 |
| 412 | VSPPVVANGK | 0.020 | 937 |
| 250 | FVEGLSFPDA | 0.020 | 938 |
| 17 | AVCVAGVETL | 0.020 | 939 |
| 114 | CVDISLDCDL | 0.020 | 940 |
| 644 | VMCGTNVCRK | 0.020 | 941 |
| 462 | FVDWLAVGHV | 0.020 | 942 |
| 320 | VDAVAELARK | 0.020 | 943 |
| 91 | HVQISYHSSH | 0.020 | 944 |
| 587 | LVNMLVLGKH | 0.020 | 945 |
| 373 | NGELQDFPYK | 0.020 | 946 |
| 147 | GGILLVNCDR | 0.018 | 947 |
| 443 | TQVVRDFLHA | 0.018 | 948 |
| 383 | RILGPDFGYV | 0.018 | 949 |
| 263 | GLISPHVTLL | 0.018 | 950 |
| 260 | GFTGLISFHV | 0.018 | 951 |
| 312 | RVRNNTCFVD | 0.018 | 952 |

TABLE XII-continued

| Pos | 1234567890 | Score | SeqID |
|---|---|---|---|
| 548 | IDWNREVLKR | 0.016 | 953 |
| 418 | ANGKEYPLGR | 0.016 | 954 |
| 192 | ALPDDHKLVL | 0.016 | 955 |
| 283 | PIFTDTVVFP | 0.016 | 956 |
| 301 | STLPPLEVYV | 0.015 | 957 |
| 431 | GGNLPGSSGR | 0.012 | 958 |
| 58 | RGRERADTRR | 0.012 | 959 |
| 501 | QEKQKCGHGR | 0.012 | 960 |
| 598 | GIPKPFGPII | 0.012 | 961 |
| 142 | GPSGYGGILL | 0.012 | 962 |
| 590 | MLVLGKHLGI | 0.012 | 963 |
| 69 | RFDATLEIIV | 0.012 | 964 |
| 357 | VQAPHKTLPV | 0.012 | 965 |
| 625 | GLHCTFIDDF | 0.012 | 966 |
| 41 | EVYGTPGVDI | 0.012 | 967 |
| 110 | LYLTCVDISL | 0.012 | 968 |
| 388 | DFGYVTREPR | 0.012 | 969 |
| 177 | LEDMSVMVLR | 0.012 | 970 |
| 22 | GVETLVDIYG | 0.012 | 971 |
| 505 | KCGHGRALLF | 0.012 | 972 |
| 477 | FVPAPDGKGF | 0.010 | 973 |
| 517 | VVDDEQVKTI | 0.010 | 974 |
| 570 | PQLFKTERKK | 0.009 | 975 |
| 516 | GVVDDEQVKT | 0.009 | 976 |
| 529 | NQVLSNKDLI | 0.009 | 977 | v.2-A11-10mers: 184P1E2

| Pos | 1234567890 | Score | SeqID |
|---|---|---|---|
| 9 | LAPLEVYVCR | 0.040 | 978 |
| 7 | STLAPLEVYV | 0.015 | 979 |
| 5 | TPSTLAPLEV | 0.004 | 980 |
| 3 | IMTPSTLAPL | 0.004 | 981 |
| 10 | APLEVYVCRV | 0.003 | 982 |
| 2 | WIMTPSTLAP | 0.002 | 983 |
| 4 | MTPSTLAPLE | 0.001 | 984 |
| 8 | TLAPLEVYVC | 0.001 | 985 |
| 1 | PWIMTPSTLA | 0.000 | 986 |
| 6 | PSTLAPLEVY | 0.000 | 987 | v.3-A11-10mers: 184P1E2

| Pos | 1234567890 | Score | SeqID |
|---|---|---|---|
| 8 | VPVPDGKGFR | 0.060 | 988 |
| 5 | LSFVPVPDGK | 0.040 | 989 |
| 7 | FVPVPDGKGF | 0.010 | 990 |
| 9 | PVPDGKGFRM | 0.006 | 991 |
| 4 | FLSPVPVPDG | 0.000 | 992 |
| 6 | SFVPVPDGKG | 0.000 | 993 |
| 10 | VPDGKGPRML | 0.000 | 994 |
| 1 | VDEFLSFVPV | 0.000 | 995 |
| 3 | EFLSFVPVPD | 0.000 | 996 |
| 2 | DEFLSFVPVP | 0.000 | 997 |

TABLE XIII

| Pos | 123456789 | Score | SeqID |
|---|---|---|---| v.1-A24-9mers: 184P1E2

| Pos | 123456789 | Score | SeqID |
|---|---|---|---|
| 95 | SYHSSHEPL | 200.000 | 998 |
| 422 | EYPLGRILI | 75.000 | 999 |
| 583 | FFPDLVNML | 51.840 | 1000 |
| 42 | VYGTPGVDI | 50.000 | 1001 |
| 318 | CFVDAVAEL | 39.600 | 1002 |
| 193 | LFDDHKLVL | 24.000 | 1003 |
| 524 | KTISINQVL | 20.160 | 1004 |
| 248 | RFFVEGLSF | 20.000 | 1005 |
| 346 | RWIQDEMEL | 13.200 | 1006 |
| 618 | RSLLEPLGL | 12.000 | 1007 |
| 69 | RFDATLEII | 10.000 | 1008 |
| 579 | KATAFFPDL | 9.600 | 1009 |
| 616 | KVRSLLEPL | 9.600 | 1010 |
| 539 | NYNKFVQSC | 9.000 | 1011 |
| 402 | SGLDSFGNL | 8.640 | 1012 |
| 442 | VTQVVRDFL | 8.400 | 1013 |
| 355 | GYVQAPHKT | 8.250 | 1014 |
| 505 | KCGHGRALL | 8.000 | 1015 |

TABLE XIII-continued

| Pos | 123456789 | Score | SeqID |
|---|---|---|---|
| 234 | KVSYEVPRL | 8.000 | 1016 |
| 110 | LYLTCVDIS | 7.500 | 1017 |
| 308 | VYVCRVRNN | 7.500 | 1018 |
| 589 | NMLVLGKHL | 7.200 | 1019 |
| 454 | KVQPPVELF | 7.200 | 1020 |
| 79 | VMNSPSNDL | 7.200 | 1021 |
| 612 | CLEEKVRSL | 7.200 | 1022 |
| 145 | GYGGILLVN | 7.000 | 1023 |
| 29 | IYGSVPEGT | 7.000 | 1024 |
| 191 | AALFDDHKL | 6.600 | 1025 |
| 491 | ASPGACFKL | 6.600 | 1026 |
| 565 | DIIDIPQLP | 6.048 | 1027 |
| 298 | MTPSTLPPL | 6.000 | 1028 |
| 417 | VANGKEYPL | 6.000 | 1029 |
| 553 | EVLKRELGL | 6.000 | 1030 |
| 222 | VCEAYRHVL | 6.000 | 1031 |
| 529 | NQVLSNKDL | 6.000 | 1032 |
| 186 | RTQGPAALF | 6.000 | 1033 |
| 263 | GLISFHVTL | 6.000 | 1034 |
| 399 | RSVSGLDSP | 6.000 | 1035 |
| 18 | VCVAGVETL | 6.000 | 1036 |
| 356 | YVQAPHKTL | 6.000 | 1037 |
| 106 | AYAVLYLTC | 6.000 | 1038 |
| 111 | YLTCVDISL | 5.600 | 1039 |
| 467 | AVGHVDEFL | 5.600 | 1040 |
| 441 | RVTQVVRDF | 5.600 | 1041 |
| 3 | LQRIVRVSL | 5.600 | 1042 |
| 205 | SYDAKRAQV | 5.000 | 1043 |
| 256 | FPDAGFTGL | 4.800 | 1044 |
| 326 | LARKAGCKL | 4.400 | 1045 |
| 482 | DGKGFRMLL | 4.000 | 1046 |
| 62 | RADTRRWRF | 4.000 | 1047 |
| 264 | LISFHVTLL | 4.000 | 1048 |
| 547 | CIDWNREVL | 4.000 | 1049 |
| 97 | HSSHEPLPL | 4.000 | 1050 |
| 241 | RLHGDEERF | 4.000 | 1051 |
| 142 | GPSGYGGIL | 4.000 | 1052 |
| 166 | NCDQHVHCL | 4.000 | 1053 |
| 32 | SVPEGTEMF | 3.600 | 1054 |
| 622 | EPLGLHCTF | 3.600 | 1055 |
| 466 | LAVGHVDEF | 3.300 | 1056 |
| 647 | GTNVCRKPF | 3.000 | 1057 |
| 582 | AFPPDLVNM | 3.000 | 1058 |
| 290 | VFRVAPWIM | 2.500 | 1059 |
| 478 | VPAPDGKGF | 2.400 | 1060 |
| 271 | LLDDSNEDF | 2.400 | 1061 |
| 492 | SPGACFKLF | 2.400 | 1062 |
| 44 | GTPGVDIYI | 2.100 | 1063 |
| 649 | NVCRKPFSF | 2.000 | 1064 |
| 506 | CGHGRALLF | 2.000 | 1065 |
| 489 | LLASPGACF | 2.000 | 1066 |
| 253 | GLSFPDAGF | 2.000 | 1067 |
| 259 | AGFTGLISF | 2.000 | 1068 |
| 598 | GIPKPFGPI | 1.800 | 1069 |
| 86 | DLNDSHVQI | 1.800 | 1070 |
| 21 | AGVETLVDI | 1.800 | 1071 |
| 141 | WGPSGYGGI | 1.500 | 1072 |
| 561 | LAECDIIDI | 1.500 | 1073 |
| 530 | QVLSNKDLI | 1.500 | 1074 |
| 559 | LGLAECDII | 1.500 | 1075 |
| 591 | LVLGKHLGI | 1.500 | 1076 |
| 542 | KFVQSCIDW | 1.500 | 1077 |
| 289 | VVFRVAPWI | 1.400 | 1078 |
| 540 | YNKFVQSCI | 1.400 | 1079 |
| 72 | ATLEIIVVN | 1.260 | 1080 |
| 599 | IPKPFGPII | 1.200 | 1081 |
| 421 | KEYPLGRIL | 1.152 | 1082 |
| 132 | NFVDKRQWV | 1.080 | 1083 |
| 629 | TFIDDFTPY | 1.080 | 1084 |
| 558 | ELGLAECDI | 1.000 | 1085 |
| 376 | LQDFPYKRI | 1.000 | 1086 |
| 109 | VLYLTCVDI | 1.000 | 1087 |
| 31 | GSVPEGTEM | 0.990 | 1088 |
| 613 | LEEKVRSLL | 0.840 | 1089 |
| 595 | KHLGIPKPF | 0.840 | 1090 |
| 426 | GRILIGGNL | 0.840 | 1091 |
| 50 | IYISPNMER | 0.825 | 1092 |

TABLE XIII-continued

| Pos | 123456789 | Score | SeqID |
|---|---|---|---|
| 66 | RRWRFDATL | 0.800 | 1093 |
| 551 | NREVLKREL | 0.792 | 1094 |
| 535 | KDLINYNKF | 0.792 | 1095 |
| 390 | GYVIREPRD | 0.750 | 1096 |
| 236 | SYEVPRLHG | 0.750 | 1097 | v.2-A24-9mers: 184P1E2

| Pos | 123456789 | Score | SeqID |
|---|---|---|---|
| 3 | MTPSTLAPL | 6.000 | 1098 |
| 1 | WIMTPSTLA | 0.150 | 1099 |
| 8 | LAPLEVYVC | 0.150 | 1100 |
| 6 | STLAPLEVY | 0.150 | 1101 |
| 7 | TLAPLEVYV | 0.144 | 1102 |
| 9 | APLEVYVCR | 0.025 | 1103 |
| 4 | TPSTLAPLE | 0.012 | 1104 |
| 2 | IMTPSTLAP | 0.012 | 1105 |
| 5 | PSTLAPLEV | 0.011 | 1106 | v.3-A24-9mers: 184P1E2

| Pos | 123456789 | Score | SeqID |
|---|---|---|---|
| 7 | VPVPDGKGF | 3.600 | 1107 |
| 9 | VPDGKGFRM | 0.500 | 1108 |
| 5 | SFVPVPDGK | 0.126 | 1109 |
| 2 | EFLSFVPVP | 0.075 | 1110 |
| 6 | FVPVPDGKG | 0.017 | 1111 |
| 3 | FLSPVPVPD | 0.014 | 1112 |
| 1 | DEPLSFVPV | 0.012 | 1113 |
| 4 | LSFVPVPDG | 0.010 | 1114 |
| 8 | PVPDGKGFR | 0.002 | 1115 |

TABLE XIV

| Pos | 1234567890 | Score | SeqID |
|---|---|---|---| v.1-A24-10mers: 184P1E2

| Pos | 1234567890 | Score | SeqID |
|---|---|---|---|
| 110 | LYLTCVDISL | 420.000 | 1116 |
| 355 | GYVQAPHKTL | 300.000 | 1117 |
| 205 | SYDAKRAQVF | 120.000 | 1118 |
| 539 | NYNKFVQSCI | 105.000 | 1119 |
| 255 | SFPDAGFTGL | 43.200 | 1120 |
| 582 | AFPPDLVNML | 34.560 | 1121 |
| 367 | VFDSPRNGEL | 22.000 | 1122 |
| 308 | VYVCRVRNNT | 12.600 | 1123 |
| 380 | PYKRILGPDF | 12.000 | 1124 |
| 441 | RVTQVVRDFL | 11.200 | 1125 |
| 612 | CLEEKVRSLL | 10.080 | 1126 |
| 466 | LAVGHVDEFL | 8.400 | 1127 |
| 2 | SLQRIVRVSL | 8.400 | 1128 |
| 503 | KQKCGHGRAL | 8.000 | 1129 |
| 611 | CCLEEKVRSL | 7.200 | 1130 |
| 101 | EPLPLAYAVL | 7.200 | 1131 |
| 588 | VNMLVLGKHL | 7.200 | 1132 |
| 546 | SCIDWNREVL | 7.200 | 1133 |
| 176 | DLEDMSVMVL | 7.200 | 1134 |
| 78 | VVMNSPSNDL | 7.200 | 1135 |
| 550 | WNREVLKREL | 6.336 | 1136 |
| 263 | GLISFHVTLL | 6.000 | 1137 |
| 528 | INQVLSNKDL | 6.000 | 1138 |
| 141 | WGPSGYGGIL | 6.000 | 1139 |
| 574 | KTERKKATAF | 6.000 | 1140 |
| 262 | TGLISFHVTL | 6.000 | 1141 |
| 604 | GPIINGCCCL | 6.000 | 1142 |
| 103 | LPLAYAVLYL | 6.000 | 1143 |
| 145 | GYGGILLVNC | 6.000 | 1144 |
| 425 | LGRILIGGNL | 5.600 | 1145 |
| 490 | LASPGACFKL | 5.280 | 1146 |
| 106 | AYAVLYLTCV | 5.000 | 1147 |
| 42 | VYGTPGVDIY | 5.000 | 1148 |
| 114 | CVDISLDCDL | 4.800 | 1149 |
| 297 | IMTPSTLPPL | 4.800 | 1150 |
| 401 | VSGLDSFGNL | 4.800 | 1151 |
| 221 | DVCEAYRHVL | 4.800 | 1152 |
| 165 | DNCDQHVHCL | 4.800 | 1153 |
| 192 | ALFDDHKLVL | 4.800 | 1154 |
| 395 | EPRDRSVSGL | 4.800 | 1155 |

TABLE XIV-continued

| Pos | 1234567890 | Score | SeqID |
|---|---|---|---|
| 480 | APDGKGFRML | 4.800 | 1156 |
| 168 | DQHVHCLQDL | 4.800 | 1157 |
| 325 | ELARKAGCKL | 4.400 | 1158 |
| 452 | AQKVQPPVEL | 4.400 | 1159 |
| 317 | TCFVDAVAEL | 4.400 | 1160 |
| 376 | LQDFPYKRIL | 4.000 | 1161 |
| 584 | FPDLVNMLVL | 4.000 | 1162 |
| 184 | VLRTQGPAAL | 4.000 | 1163 |
| 241 | PLHGDEERFF | 4.000 | 1164 |
| 294 | APWIMTPSTL | 4.000 | 1165 |
| 142 | GPSGYGGILL | 4.000 | 1166 |
| 505 | KCGHGPALLF | 4.000 | 1167 |
| 17 | AVCVAGVETL | 4.000 | 1168 |
| 563 | ECDIIDIPQL | 4.000 | 1169 |
| 94 | ISYHSSHEPL | 4.000 | 1170 |
| 416 | VVANGKEYPL | 4.000 | 1171 |
| 491 | ASPGACFKLF | 3.600 | 1172 |
| 270 | TLLDDSNEDF | 3.600 | 1173 |
| 31 | GSVPEGTEMF | 3.600 | 1174 |
| 282 | SPIFTDTVVF | 3.000 | 1175 |
| 648 | TNVCRKPFSF | 3.000 | 1176 |
| 124 | NCEGRQDRNF | 3.000 | 1177 |
| 252 | EGLSFPDAGF | 3.000 | 1178 |
| 477 | FVPAPDGKGF | 3.000 | 1179 |
| 488 | MLLASPGACF | 3.000 | 1180 |
| 370 | SPRNGELQDF | 2.400 | 1181 |
| 468 | VGHVDEFLSF | 2.400 | 1182 |
| 359 | APHKTLPVVF | 2.400 | 1183 |
| 465 | WLAVGHVDEF | 2.200 | 1184 |
| 67 | RWRFDATLEI | 2.200 | 1185 |
| 597 | LGIPKPFGPI | 2.160 | 1186 |
| 288 | TXTVFRVAPW | 2.100 | 1187 |
| 646 | CGTNVCRKPF | 2.000 | 1188 |
| 310 | VCRVRNNTCF | 2.000 | 1189 |
| 258 | DAGFTGLISP | 2.000 | 1190 |
| 625 | GLHCTFIDDF | 2.000 | 1191 |
| 275 | SNEDFSASPI | 1.800 | 1192 |
| 375 | ELQDFPYKRI | 1.800 | 1193 |
| 443 | YGTPGVDIYI | 1.680 | 1194 |
| 343 | RNDRWIQDEM | 1.540 | 1195 |
| 339 | QAENRNDRWI | 1.500 | 1196 |
| 108 | AVLYLTCVDI | 1.500 | 1197 |
| 622 | EPLGLHCTFI | 1.500 | 1198 |
| 542 | KFVQSCIDWN | 1.500 | 1199 |
| 598 | GIPKPFGPII | 1.500 | 1200 |
| 529 | NQVLSNKDLI | 1.500 | 1201 |
| 590 | MLVLGKHLGI | 1.500 | 1202 |
| 318 | CFVDAVAELA | 1.260 | 1203 |
| 583 | FFPDLVNMLV | 1.260 | 1204 |
| 560 | GLAECDIIDI | 1.200 | 1205 |
| 517 | VVDDEQVKTI | 1.200 | 1206 |
| 140 | VWGPSGYGGI | 1.200 | 1207 |
| 69 | RFDATLEIIV | 1.200 | 1208 |
| 552 | REVLKRELGL | 1.200 | 1209 |
| 419 | NGKEYPLGRI | 1.200 | 1210 |
| 207 | DAKRAQVFHI | 1.000 | 1211 |
| 256 | FPDAGFTGLI | 1.000 | 1212 |
| 20 | VAGVETLVDI | 1.000 | 1213 |
| 41 | EVYGTPGVDI | 1.000 | 1214 |
| 653 | KPFSFKWWNM | 1.000 | 1215 | v.2-A24-10mers: 184P1E2

| Pos | 1234567890 | Score | SeqID |
|---|---|---|---|
| 3 | IMTPSTLAPL | 4.800 | 1216 |
| 7 | STLAPLEVYV | 0.180 | 1217 |
| 10 | APLEVYVCRV | 0.180 | 1218 |
| 8 | ThAPLEVYVC | 0.120 | 1219 |
| 5 | TPSTLAPLEV | 0.110 | 1220 |
| 9 | LAPLEVYVCR | 0.021 | 1221 |
| 4 | MTPSTLAPLE | 0.018 | 1222 |
| 1 | PWIMTPSTLA | 0.015 | 1223 |
| 2 | WIMTPSTLAP | 0.015 | 1224 |
| 6 | PSTLAPLEVY | 0.010 | 1225 | v.3-A24-10mers: 184P1E2

| Pos | 1234567890 | Score | SeqID |
|---|---|---|---|
| 10 | VPDGKGFRML | 4.800 | 1226 |
| 7 | FVPVPDGKGF | 3.000 | 1227 |
| 3 | EFLSFVPVPD | 0.105 | 1228 |

TABLE XIV-continued

| Pos | 1234567890 | Score | SeqID |
|---|---|---|---|
| 6 | SFVPVPDGKG | 0.099 | 1229 |
| 9 | PVPDGKGFRM | 0.090 | 1230 |
| 1 | VDSELSFVPV | 0.018 | 1231 |
| 8 | VPVPDGKGFR | 0.018 | 1232 |
| 5 | LSFVPVPDGK | 0.014 | 1233 |
| 4 | FLSFVPVPDG | 0.010 | 1234 |
| 2 | DEFLSFVPVP | 0.001 | 1235 |

TABLE XV

| Pos | 123456789 | Score | SeqID |
|---|---|---|---|
| | v.1-B7-9mers: 184P1E2 | | |
| 616 | KVRSLLEPL | 200.000 | 1236 |
| 326 | LARKAGCKL | 120.000 | 1237 |
| 142 | GPSGYGGIL | 80.000 | 1238 |
| 467 | AVGHVDEFL | 60.000 | 1239 |
| 3 | LQRIVRVSL | 60.000 | 1240 |
| 191 | AALFDDHKL | 36.000 | 1241 |
| 356 | YVQAPHKTL | 30.000 | 1242 |
| 256 | FPDAGFTGL | 24.000 | 1243 |
| 553 | EVLKRELOL | 20.000 | 1244 |
| 234 | KVSYEVPRL | 20.000 | 1245 |
| 480 | APDGKGFRM | 18.000 | 1246 |
| 417 | VANGKEYPL | 12.000 | 1247 |
| 579 | KATAFFPDL | 12.000 | 1248 |
| 491 | ASPGACFKL | 12.000 | 1249 |
| 359 | APHKTLPVV | 12.000 | 1250 |
| 312 | RVRNNTCFV | 10.000 | 1251 |
| 599 | IPKPFGPII | 8.000 | 1252 |
| 294 | APWIMTPST | 6.000 | 1253 |
| 442 | VTQVVRDFL | 6.000 | 1254 |
| 482 | DGKGFRMLL | 6.000 | 1255 |
| 79 | VMNSPSNDL | 6.000 | 1256 |
| 505 | KCGHGRALL | 6.000 | 1257 |
| 263 | GLISPHVTL | 4.000 | 1258 |
| 589 | NMLVLGKHL | 4.000 | 1259 |
| 246 | EERFFVEGL | 4.000 | 1260 |
| 402 | SGLDSFGNL | 4.000 | 1261 |
| 264 | LISFHVTLL | 4.000 | 1262 |
| 18 | VCVAGVETL | 4.000 | 1263 |
| 101 | EPLPLAYAV | 4.000 | 1264 |
| 529 | NQVLSNKDL | 4.000 | 1265 |
| 524 | KTISINQVL | 4.000 | 1266 |
| 97 | HSSHEPLPL | 4.000 | 1267 |
| 618 | RSLLEPLGL | 4.000 | 1268 |
| 111 | YLTCVDISL | 4.000 | 1269 |
| 434 | LPGSSGRRV | 4.000 | 1270 |
| 282 | SPIFTDTVV | 4.000 | 1271 |
| 298 | MTPSTLPPL | 4.000 | 1272 |
| 126 | EGRQDRNFV | 3.000 | 1273 |
| 72 | ATLEIIVVM | 3.000 | 1274 |
| 438 | SGRRVTQVV | 2.000 | 1275 |
| 13 | HPTSAVCVA | 2.000 | 1276 |
| 395 | EPRDRSVSG | 2.000 | 1277 |
| 604 | GPIINGCCC | 2.000 | 1278 |
| 530 | QVLSWKDLI | 2.000 | 1279 |
| 303 | LPPLEVYVC | 2.000 | 1280 |
| 239 | VPRLHGDEE | 2.000 | 1281 |
| 591 | LVLGKMLGI | 2.000 | 1282 |
| 289 | VVFRVAPWI | 2.000 | 1283 |
| 370 | SPRNGELQD | 2.000 | 1284 |
| 547 | CIDWNREVL | 1.800 | 1285 |
| 222 | VCEAYRHVL | 1.800 | 1286 |
| 64 | DTRRWRFDA | 1.500 | 1287 |
| 17 | AVCVAGVET | 1.500 | 1288 |
| 322 | AVAELARKA | 1.500 | 1289 |
| 21 | AGVETLVDI | 1.200 | 1290 |
| 166 | NCDQHVHCL | 1.200 | 1291 |
| 208 | AKRAQVFHI | 1.200 | 1292 |
| 584 | FPDLVNMLV | 1.200 | 1293 |
| 612 | CLEEKVRSL | 1.200 | 1294 |
| 31 | GSVPEGTEH | 1.000 | 1295 |

TABLE XV-continued

| Pos | 123456789 | Score | SeqID |
|---|---|---|---|
| 19 | CVAGVETLV | 1.000 | 1296 |
| 310 | VCRVRNNTC | 1.000 | 1297 |
| 221 | DVCEAYRHV | 1.000 | 1298 |
| 344 | NDRWIQDEM | 1.000 | 1299 |
| 184 | VLRTQGPAA | 1.000 | 1300 |
| 290 | VFRVAPWIM | 1.000 | 1301 |
| 172 | NCLQDLEDM | 1.000 | 1302 |
| 309 | YVCRVRNNT | 0.750 | 1303 |
| 107 | YAVLYLTCV | 0.600 | 1304 |
| 580 | ATAFFPDLV | 0.600 | 1305 |
| 451 | HAQKVQPPV | 0.600 | 1306 |
| 453 | QKVQPPVEL | 0.600 | 1307 |
| 598 | GIPKPFGPI | 0.600 | 1308 |
| 510 | RALLFQGVV | 0.600 | 1309 |
| 632 | DDFTPYHML | 0.600 | 1310 |
| 358 | QAPHKTLPV | 0.600 | 1311 |
| 192 | ALFDDHKLV | 0.600 | 1312 |
| 281 | ASPIFTDTV | 0.600 | 1313 |
| 71 | DATLEIIVV | 0.600 | 1314 |
| 458 | PVELPVDWL | 0.600 | 1315 |
| 6 | IVRVSLEHP | 0.500 | 1316 |
| 445 | VVRDFLHAQ | 0.500 | 1317 |
| 643 | EVHCGTNVC | 0.500 | 1318 |
| 183 | MVLRTQGPA | 0.500 | 1319 |
| 444 | QVVRDFLHA | 0.500 | 1320 |
| 392 | VTREPRDRS | 0.450 | 1321 |
| 143 | PSGYGGILL | 0.400 | 1322 |
| 377 | QDFPYKRIL | 0.400 | 1323 |
| 564 | CDIIDIPQL | 0.400 | 1324 |
| 492 | SPGACFKLF | 0.400 | 1325 |
| 368 | FDSPRNGEL | 0.400 | 1326 |
| 169 | QHVHCLQDL | 0.400 | 1327 |
| 622 | EPLGLHCTF | 0.400 | 1328 |
| 421 | KEYPLGRIL | 0.400 | 1329 |
| 346 | RWIQDEMEL | 0.400 | 1330 |
| 653 | KPFSFKWWN | 0.400 | 1331 |
| 504 | QKCGHGRAL | 0.400 | 1332 |
| 540 | YNKFVQSCI | 0.400 | 1333 |
| 104 | PLAYAVLYL | 0.400 | 1334 |
| 44 | GTPGVDIYI | 0.400 | 1335 |
| | v.2-B7-9mers: 184P1E2 | | |
| 3 | MTPSTLAPL | 4.000 | 1336 |
| 9 | APLEVYVCR | 0.600 | 1337 |
| 1 | WIMTPSTLA | 0.450 | 1338 |
| 8 | LAPLEVYVC | 0.300 | 1339 |
| 4 | TPSTLAPLE | 0.200 | 1340 |
| 7 | TLAPLEVYV | 0.200 | 1341 |
| 6 | STLAPLEVY | 0.030 | 1342 |
| 5 | PSTLAPLEV | 0.020 | 1343 |
| 2 | IMTPSTLAP | 0.010 | 1344 |
| | v.3-B7-9mers: 184P1E2 | | |
| 9 | VPDGKGFRIVI | 6.000 | 1345 |
| 7 | VPVPDGKGF | 0.400 | 1346 |
| 6 | FVPVPDGKG | 0.075 | 1347 |
| 1 | DEFLSFVPV | 0.020 | 1348 |
| 4 | LSFVPVPDG | 0.015 | 1349 |
| 3 | FLSFVPVPD | 0.010 | 1350 |
| 8 | PVPDGKGFR | 0.005 | 1351 |
| 2 | EFLSFVPVP | 0.001 | 1352 |
| 5 | SFVPVPDGK | 0.001 | 1353 |

TABLE XVI

| Pos | 1234567890 | Score | SeqID |
|---|---|---|---|
| | v.1-B7-10mers: 184P1E2 | | |
| 395 | EPRDRSVSGL | 800.000 | 1354 |
| 294 | APWIMTPSTL | 240.000 | 1355 |
| 78 | VVMNSPSNDL | 90.000 | 1356 |
| 142 | GPSGYGGILL | 80.000 | 1357 |
| 604 | GPIINGCCCL | 80.000 | 1358 |

TABLE XVI-continued

| Pos | 1234567890 | Score | SeqID |
|---|---|---|---|
| 101 | EPLPLAYAVL | 80.000 | 1359 |
| 103 | LPLAYAVLYL | 80.000 | 1360 |
| 480 | APDGKGFRML | 72.000 | 1361 |
| 17 | AVCVAGVETL | 60.000 | 1362 |
| 425 | LGRILIGGNL | 40.000 | 1363 |
| 184 | VLRTQGPAAL | 40.000 | 1364 |
| 550 | WNREVLKREL | 40.000 | 1365 |
| 441 | RVTQVVRDFL | 30.000 | 1366 |
| 221 | DVCEAYRHVL | 30.000 | 1367 |
| 584 | FPDLVNMLVL | 24.000 | 1368 |
| 416 | VVANGKEYPL | 20.000 | 1369 |
| 653 | KPFSFKWWNM | 20.000 | 1370 |
| 452 | AQKVQPPVEL | 18.000 | 1371 |
| 588 | VNMLVLGKHL | 12.000 | 1372 |
| 466 | LAVGHVDEFL | 12.000 | 1373 |
| 192 | ALFDDHKLVL | 12.000 | 1374 |
| 490 | LASPGACPKL | 12.000 | 1375 |
| 622 | EPLGLHCTFI | 8.000 | 1376 |
| 457 | PPVELFVDWL | 8.000 | 1377 |
| 546 | SCIDWNREVL | 6.000 | 1378 |
| 114 | CVDISLDCDL | 6.000 | 1379 |
| 299 | TPSTLPPLEV | 6.000 | 1380 |
| 2 | SLQRIVRVSL | 6.000 | 1381 |
| 108 | AVLYLTCVDI | 6.000 | 1382 |
| 289 | VVFRVAPWIM | 5.000 | 1383 |
| 6 | IVRVSLEHPT | 5.000 | 1384 |
| 401 | VSGLDSFGNL | 4.000 | 1385 |
| 611 | CCLEEKVRSL | 4.000 | 1386 |
| 503 | KQKCGHGRAL | 4.000 | 1387 |
| 141 | WGPSGYGGIL | 4.000 | 1388 |
| 635 | TPYMMLHGEV | 4.000 | 1389 |
| 325 | ELARKAGCKL | 4.000 | 1390 |
| 317 | TCFVDAVAEL | 4.000 | 1391 |
| 263 | GLISFHVTLL | 4.000 | 1392 |
| 297 | IMTPSTLPPL | 4.000 | 1393 |
| 370 | SPRNGELQDF | 4.000 | 1394 |
| 65 | TRRWRFDATL | 4.000 | 1395 |
| 528 | INQVLSNKDL | 4.000 | 1396 |
| 165 | DNCDQHVHCL | 4.000 | 1397 |
| 168 | DQHVHCLQDL | 4.000 | 1398 |
| 94 | ISYHSSHEPL | 4.000 | 1399 |
| 262 | TGLISFMVTL | 4.000 | 1400 |
| 71 | DATLEIIVVN | 3.000 | 1401 |
| 434 | LPGSSGRRVT | 3.000 | 1402 |
| 326 | LARKAGCKLT | 3.000 | 1403 |
| 41 | EVYGTPGVDI | 3.000 | 1404 |
| 581 | TAFFPDLVNM | 3.000 | 1405 |
| 256 | FPDAGFTGLI | 2.400 | 1406 |
| 158 | DPSCDVQDNC | 2.000 | 1407 |
| 508 | HGRALLFQGV | 2.000 | 1408 |
| 288 | TVVFRVAPWI | 2.000 | 1409 |
| 392 | VTREPRDRSV | 2.000 | 1410 |
| 601 | KPFGPIINGC | 2.000 | 1411 |
| 239 | VPRLHGDEER | 2.000 | 1412 |
| 191 | AALFDDHKLV | 1.800 | 1413 |
| 612 | CLEEKVRSLL | 1.800 | 1414 |
| 47 | GVDIYISPNM | 1.500 | 1415 |
| 563 | ECDIIDIPQL | 1.200 | 1416 |
| 190 | PAALFDDHKL | 1.200 | 1417 |
| 176 | DLEDMSVNVL | 1.200 | 1418 |
| 376 | LQDFPYKRIL | 1.200 | 1419 |
| 33 | VPEGTEMPEV | 1.200 | 1420 |
| 359 | APHKTLPVVF | 1.200 | 1421 |
| 207 | DAKRAQVFHI | 1.200 | 1422 |
| 20 | VAGVETLVDI | 1.200 | 1423 |
| 582 | AFFPDLVNML | 1.200 | 1424 |
| 64 | DTRRWRFDAT | 1.000 | 1425 |
| 30 | YGSVP[]GTEM | 1.000 | 1426 |
| 454 | KVQPPVELFV | 1.000 | 1427 |
| 162 | DVQDNCDQHV | 1.000 | 1428 |
| 522 | QVKTISINQV | 1.000 | 1429 |
| 504 | QKCGHGRALL | 0.600 | 1430 |
| 579 | KATAFFPDLV | 0.600 | 1431 |
| 355 | GYVQAPHKTL | 0.600 | 1432 |
| 597 | LGIPKPFGPI | 0.600 | 1433 |
| 419 | NGKEYPLGRI | 0.600 | 1434 |
| 281 | ASPIFTDTVV | 0.600 | 1435 |

TABLE XVI-continued

| Pos | 1234567890 | Score | SeqID |
|---|---|---|---|
| 375 | ELQDFPYKRI | 0.600 | 1436 |
| 358 | QAPHKTLPVV | 0.600 | 1437 |
| 280 | SASPIFTDTV | 0.600 | 1438 |
| 517 | VVDDEQVKTI | 0.600 | 1439 |
| 199 | LVLHTSSYDA | 0.500 | 1440 |
| 553 | EVLKRELGLA | 0.500 | 1441 |
| 8 | RVSLEHPTSA | 0.500 | 1442 |
| 183 | MVLRTQGPAA | 0.500 | 1443 |
| 445 | VVRDFLHAQK | 0.500 | 1444 |
| 312 | RVRNNTCPVD | 0.500 | 1445 |
| 616 | KVRSLLEPLG | 0.500 | 1446 |
| 309 | YVCRVRNNTC | 0.500 | 1447 |
| 516 | GVVDDEQVKT | 0.500 | 1448 |
| 43 | YGTPGVDIYI | 0.400 | 1449 |
| 578 | KKATAPFPDL | 0.400 | 1450 |
| 599 | IPKPFGPIIN | 0.400 | 1451 |
| 456 | QPPVELFVDW | 0.400 | 1452 |
| 233 | DKVSYEVPRL | 0.400 | 1453 |
| v.2-B7-10mers: 184P1E2 | | | |
| 10 | APLEVYVCRV | 12.000 | 1454 |
| 5 | TPSTLAPLEV | 4.000 | 1455 |
| 3 | IMTPSTLAPL | 4.000 | 1456 |
| 7 | STLAPLEVYV | 0.200 | 1457 |
| 8 | TLAPLEVYVC | 0.100 | 1458 |
| 9 | LAPLEVYVCR | 0.030 | 1459 |
| 2 | WIMTPSTLAP | 0.030 | 1460 |
| 4 | MTPSTLAPLE | 0.010 | 1461 |
| 6 | PSTLAPLEVY | 0.003 | 1462 |
| 1 | PWIMTPSTLA | 0.002 | 1463 |
| v.3-B7-10mers: 184P1E2 | | | |
| 10 | VPDGKGFRML | 24.000 | 1464 |
| 9 | PVPDGKGFRM | 0.500 | 1465 |
| 8 | VPVPDGKGFR | 0.200 | 1466 |
| 7 | FVPVPDGKGF | 0.100 | 1467 |
| 4 | FLSFVPVPDG | 0.015 | 1468 |
| 5 | LSFVPVPDGK | 0.010 | 1469 |
| 1 | VDEFLSFVPV | 0.006 | 1470 |
| 6 | SFVPVPDGKG | 0.002 | 1471 |
| 2 | DEFLSFVPVP | 0.001 | 1472 |
| 3 | EFLSFVPVPD | 0.001 | 1473 |

TABLE XVII

| Pos | 123456789 | Score | SeqID |
|---|---|---|---|
| v.1-B35-9mers: 184P1E2 | | | |
| 103 | LPLAYAVLY | 40.000 | 1474 |
| 478 | VPAPDKGF | 30.000 | 1475 |
| 218 | GPEDVCEAY | 24.000 | 1476 |
| 599 | IPKPFGPII | 24.000 | 1477 |
| 492 | SPGACPKLF | 20.000 | 1478 |
| 622 | EPLGLHCTF | 20.000 | 1479 |
| 142 | GPSGYGGIL | 20.000 | 1480 |
| 31 | GSVPEGTEM | 15.000 | 1481 |
| 618 | RSLLEPLGL | 15.000 | 1482 |
| 532 | LSNKDLINY | 15.000 | 1483 |
| 480 | APDGKGFRM | 12.000 | 1484 |
| 399 | RSVSGLDSF | 10.000 | 1485 |
| 326 | LARKAGCKL | 9.000 | 1486 |
| 97 | HSSHEPLPL | 7.500 | 1487 |
| 579 | KATAFFPDL | 6.000 | 1488 |
| 256 | FPDAGFTGL | 6.000 | 1489 |
| 616 | KVRSLLEPL | 6.000 | 1490 |
| 491 | ASPGACFKL | 5.000 | 1491 |
| 191 | AALFDDHKL | 4.500 | 1492 |
| 101 | EPLPLAYAV | 4.000 | 1493 |
| 359 | APHKTLPVV | 4.000 | 1494 |
| 35 | EGTEMFEVY | 4.000 | 1495 |
| 434 | LPGSSGRRV | 4.000 | 1496 |
| 383 | RILGPDFGY | 4.000 | 1497 |
| 282 | SPIFTDTVV | 4.000 | 1498 |

TABLE XVII-continued

| Pos | 123456789 | Score | SeqID |
|---|---|---|---|
| 653 | KPFSFKWWN | 4.000 | 1499 |
| 198 | KLVLHTSSY | 4.000 | 1500 |
| 72 | ATLEIIVVM | 4.000 | 1501 |
| 417 | VANGKEYPL | 3.000 | 1502 |
| 158 | DPSCDVQDN | 3.000 | 1503 |
| 3 | LQEIVRVSL | 3.000 | 1504 |
| 172 | HCLQDLEDM | 3.000 | 1505 |
| 241 | RLHGDEERF | 3.000 | 1506 |
| 482 | DGKGFRMLL | 3.000 | 1507 |
| 466 | LAVGHVDEF | 3.000 | 1508 |
| 229 | VLGQDKVSY | 3.000 | 1509 |
| 82 | SPSNDLNDS | 3.000 | 1510 |
| 303 | LPPLEVYVC | 3.000 | 1511 |
| 234 | KVSYEVPRL | 3.000 | 1512 |
| 45 | TPGVDIYIS | 3.000 | 1513 |
| 441 | RVTQVVRDF | 2.000 | 1514 |
| 402 | SGLDSFGNL | 2.000 | 1515 |
| 294 | APWIMTPST | 2.000 | 1516 |
| 604 | GPIINGCCC | 2.000 | 1517 |
| 524 | KTISINQVL | 2.000 | 1518 |
| 565 | DIIDIPQLF | 2.000 | 1519 |
| 454 | KVQPPVELF | 2.000 | 1520 |
| 457 | PPVELFVDW | 2.000 | 1521 |
| 505 | KCGHGRALL | 2.000 | 1522 |
| 32 | SVPEGTEMF | 2.000 | 1523 |
| 13 | HPTSAVCVA | 2.000 | 1524 |
| 186 | RTQGPAALF | 2.000 | 1525 |
| 43 | YGTPGVDIY | 2.000 | 1526 |
| 301 | STLPPLEVY | 2.000 | 1527 |
| 62 | RADTRRWRF | 1.800 | 1528 |
| 274 | DSNEDPSAS | 1.500 | 1529 |
| 131 | RNFVDKRQW | 1.500 | 1530 |
| 510 | RALLFQGVV | 1.200 | 1531 |
| 312 | RVRNNTCFV | 1.200 | 1532 |
| 540 | YNKFVQSCI | 1.200 | 1533 |
| 348 | IQDEMELGY | 1.200 | 1534 |
| 584 | FPDLVNMLV | 1.200 | 1535 |
| 395 | EPRDRSVSG | 1.200 | 1536 |
| 9 | VSLEHPTSA | 1.000 | 1537 |
| 356 | YVQAPHKTL | 1.000 | 1538 |
| 589 | NMLVLGKML | 1.000 | 1539 |
| 79V | MNSPSNDLI | 1.000 | 1540 |
| 264 | LISPHVTLL | 1.000 | 1541 |
| 15 | TSAVCVAGV | 1.000 | 1542 |
| 467 | AVGHVDEFL | 1.000 | 1543 |
| 263 | GLISFHVTL | 1.000 | 1544 |
| 506 | CGHGRALLF | 1.000 | 1545 |
| 442 | VTQVVRDFL | 1.000 | 1546 |
| 98 | SSHEPLPLA | 1.000 | 1547 |
| 647 | GTNVCRKPF | 1.000 | 1548 |
| 553 | EVLKRELGL | 1.000 | 1549 |
| 253 | GLSFPDAGF | 1.000 | 1550 |
| 1 | MSLQRIVRV | 1.000 | 1551 |
| 117 | ISLDCDLNC | 1.000 | 1552 |
| 281 | ASPIFTDTV | 1.000 | 1553 |
| 18 | VCVAGVETL | 1.000 | 1554 |
| 655 | FSFKWWNMV | 1.000 | 1555 |
| 529 | NQVLSNKDL | 1.000 | 1556 |
| 649 | NVCRKPFSF | 1.000 | 1557 |
| 111 | YLTCVDISL | 1.000 | 1558 |
| 298 | MTPSTLPPL | 1.000 | 1559 |
| 259 | AGFTGLISF | 1.000 | 1560 |
| 437 | SSGRRVTQV | 1.000 | 1561 |
| 489 | LLASPGACF | 1.000 | 1562 |
| 126 | EGRQDRNFV | 0.900 | 1563 |
| 71 | DATLEIIVV | 0.900 | 1564 |
| 86 | DLNDSHVQI | 0.800 | 1565 |
| 21 | AGVETLVDI | 0.800 | 1566 |
| 254 | LSFPDAGFT | 0.750 | 1567 |
| 401 | VSGLDSFGN | 0.750 | 1568 |
| 203 | TSSYDAKRA | 0.750 | 1569 |
| 629 | TPIDDFTPY | 0.600 | 1570 |
| 344 | MORWIODEM | 0.600 | 1571 |
| 612 | CLEEKVRSL | 0.600 | 1572 |
| 22 | GVETLVDIY | 0.600 | 1573 |

TABLE XVII-continued

| Pos | 123456789 | Score | SeqID |
|---|---|---|---|
| v.2-B35-9mers: 184P1E2 | | | |
| 6 | STLAPLEVY | 2.000 | 1574 |
| 3 | MTPSTLAPL | 1.000 | 1575 |
| 8 | LAPLEVYVC | 0.450 | 1576 |
| 9 | APLEVYVCR | 0.400 | 1577 |
| 7 | TLAPLEVYV | 0.200 | 1578 |
| 4 | TPSTLAPLE | 0.200 | 1579 |
| 5 | PSTLAPLEV | 0.100 | 1580 |
| 1 | WIMTPSTLA | 0.100 | 1581 |
| 2 | IMTPSTLAP | 0.010 | 1582 |
| v.3-B35-9mers: 184P1E2 | | | |
| 7 | VPVPDGKGF | 30.000 | 1583 |
| 9 | VPDGKGFRM | 12.000 | 1584 |
| 4 | LSFVPVPDG | 0.050 | 1585 |
| 1 | DEFLSFVPV | 0.020 | 1586 |
| 6 | FVPVPDGKG | 0.010 | 1587 |
| 3 | FLSPVPVPD | 0.010 | 1588 |
| 8 | PVPDGKGPR | 0.002 | 1589 |
| 2 | EFLSFVPVP | 0.001 | 1590 |
| 5 | SFVPVPDGK | 0.001 | 1591 |

TABLE XVIII

| Pos | 1234567890 | Score | SeqID |
|---|---|---|---|
| v.1-B35-10mers: 184P1E2 | | | |
| 395 | EPRDRSVSGL | 120.000 | 1592 |
| 370 | SPRNGELQDF | 90.000 | 1593 |
| 653 | KPFSFKWWNM | 80.000 | 1594 |
| 282 | SPIFTDTVVF | 30.000 | 1595 |
| 294 | APWIMTPSTL | 20.000 | 1596 |
| 98 | SSHEPLPLAY | 20.000 | 1597 |
| 103 | LPLAYAVLYL | 20.000 | 1598 |
| 359 | APHKTLPVVF | 20.000 | 1599 |
| 142 | GPSGYGGILL | 20.000 | 1600 |
| 101 | EPLPLAYAVL | 20.000 | 1601 |
| 604 | GPIINGCCCL | 20.000 | 1602 |
| 456 | QPPVELFVDW | 10.000 | 1603 |
| 581 | TAFPPDLVNM | 9.000 | 1604 |
| 372 | RNGELQDFPY | 8.000 | 1605 |
| 622 | EPLGLHCTFI | 8.000 | 1606 |
| 550 | WNREVLKREL | 6.000 | 1607 |
| 599 | IPKPFGPIIN | 6.000 | 1608 |
| 480 | APDGKGFRML | 6.000 | 1609 |
| 503 | KQKCGHGRAL | 6.000 | 1610 |
| 584 | FPDLVNMLVL | 6.000 | 1611 |
| 71 | DATLEIIVVM | 6.000 | 1612 |
| 94 | ISYHSSHEPL | 5.000 | 1613 |
| 31 | GSVPEGTEMF | 5.000 | 1614 |
| 401 | VSGLDSFGNL | 5.000 | 1615 |
| 491 | ASPGACFKLF | 5.000 | 1616 |
| 414 | PPVVANGKEY | 4.000 | 1617 |
| 21 | AGVETLVDIY | 4.000 | 1618 |
| 137 | RQWVWCPSGY | 4.000 | 1619 |
| 457 | PPVELFVDWL | 4.000 | 1620 |
| 347 | WIQDEMELGY | 4.000 | 1621 |
| 635 | TPYHMLGEV | 4.000 | 1622 |
| 299 | TPSTLPPLEV | 4.000 | 1623 |
| 217 | CGPEDVCEAY | 4.000 | 1624 |
| 601 | KPPGPIINGC | 4.000 | 1625 |
| 207 | DAKRAQVFHI | 3.600 | 1626 |
| 531 | VLSNKDLINY | 3.000 | 1627 |
| 241 | RLHGDEERFF | 3.000 | 1628 |
| 364 | LPVVFDSPRN | 3.000 | 1629 |
| 490 | LASPGACFKL | 3.000 | 1630 |
| 184 | VLRTQGPAAL | 3.000 | 1631 |
| 258 | DAGFTGLISF | 3.000 | 1632 |
| 628 | CTFIDDFTPY | 3.000 | 1633 |
| 452 | AQKVQPPVEL | 3.000 | 1634 |
| 310 | VCRVRNNTCP | 3.000 | 1635 |
| 30 | YGSVPEGTEM | 3.000 | 1636 |

TABLE XVIII-continued

| Pos | 1234567890 | Score | SeqID |
|---|---|---|---|
| 228 | HVLGQDKVSY | 3.000 | 1637 |
| 425 | LGRILIGGNL | 3.000 | 1638 |
| 466 | LAVGHVDEFL | 3.000 | 1639 |
| 256 | FPDAGFTGLI | 2.400 | 1640 |
| 419 | NGKEYPLGRI | 2.400 | 1641 |
| 204 | SSYDAKRAQV | 2.000 | 1642 |
| 192 | ALFDDHKLVL | 2.000 | 1643 |
| 158 | DPSCDVQDNc | 2.000 | 1644 |
| 289 | VVFRVAPWIM | 2.000 | 1645 |
| 546 | SCIDWNREVL | 2.000 | 1646 |
| 221 | DVCEAYRHVL | 2.000 | 1647 |
| 165 | DNCDQHVHCL | 2.000 | 1648 |
| 434 | LPGSSORRVT | 2.000 | 1649 |
| 9 | VSLEHPTSAV | 2.000 | 1650 |
| 270 | TLLDDSNEDF | 2.000 | 1651 |
| 441 | RVTQVVRDFL | 2.000 | 1652 |
| 505 | KCGHGRALLF | 2.000 | 1653 |
| 611 | CCLEEKVRSL | 2.000 | 1654 |
| 33 | VPEGTEMPEV | 1.800 | 1655 |
| 477 | FVPAPDGKGP | 1.500 | 1656 |
| 650 | VCRKPFSFKW | 1.500 | 1657 |
| 468 | VGHVDEFLSF | 1.500 | 1658 |
| 343 | RNDRWIQDEM | 1.200 | 1659 |
| 392 | VTREPRDRSV | 1.200 | 1660 |
| 560 | GLAECDIIDI | 1.200 | 1661 |
| 630 | FIDDFTPYHM | 1.200 | 1662 |
| 579 | KATAFFPDLV | 1.200 | 1663 |
| 479 | PAPDGKGFRM | 1.200 | 1664 |
| 20 | VAGVETLVDI | 1.200 | 1665 |
| 648 | TNVCRKPFSP | 1.000 | 1666 |
| 300 | PSTLPPLEVY | 1.000 | 1667 |
| 528 | INQVLSNKDL | 1.000 | 1668 |
| 317 | TCFVDAVAEL | 1.000 | 1669 |
| 78 | VVMNSPSNDL | 1.000 | 1670 |
| 262 | TGLISFHVTL | 1.000 | 1671 |
| 281 | ASPIFTDTVV | 1.000 | 1672 |
| 263 | GLISFHVTLL | 1.000 | 1673 |
| 2 | SLQRIVRVSL | 1.000 | 1674 |
| 545 | QSCIDWNREV | 1.000 | 1675 |
| 297 | IMTPSTLPPL | 1.000 | 1676 |
| 436 | GSSGRRVTQV | 1.000 | 1677 |
| 437 | SSGRRVTQVV | 1.000 | 1678 |
| 17 | AVCVAGVETL | 1.000 | 1679 |
| 325 | ELARKAGCKL | 1.000 | 1680 |
| 646 | CGTNVCRKPF | 1.000 | 1681 |
| 625 | GLHCTFIDDF | 1.000 | 1682 |
| 141 | WGPSGYGGIL | 1.000 | 1683 |
| 168 | DQHVHCLQDL | 1.000 | 1684 |
| 588 | VNMLVLGKHL | 1.000 | 1685 |
| 252 | EGLSFPDAGF | 1.000 | 1686 |
| 465 | WLAVGHVDEF | 1.000 | 1687 |
| 416 | VVANGKEYPL | 1.000 | 1688 |
| 488 | MLLASPGACF | 1.000 | 1689 |
| 174 | LQDLEDMSVM | 0.900 | 1690 |
| 191 | AALFDDHKLV | 0.900 | 1691 |
| v.2-B35-10mers | | | |
| 10 | APLEVYVCRV | 8.000 | 1692 |
| 5 | TPSTLAPLEV | 4.000 | 1693 |
| 6 | PSTLAPLEVY | 1.000 | 1694 |
| 3 | IMTPSTLAPL | 1.000 | 1695 |
| 7 | STLAPLEVYV | 0.200 | 1696 |
| 8 | TLAPLEVYVC | 0.150 | 1697 |
| 9 | LAPLEVYVCR | 0.030 | 1698 |
| 4 | MTPSTLAPLE | 0.010 | 1699 |
| 2 | WIMTPSTLAP | 0.010 | 1700 |
| 1 | PWIMTPSTLA | 0.001 | 1701 |
| v.3-B35-10mers | | | |
| 10 | VPDGKGFRML | 6.000 | 1702 |
| 7 | FVPVPDGKGF | 1.500 | 1703 |
| 9 | PVPDGKGFRM | 0.400 | 1704 |
| 8 | VPVPDGKGFR | 0.200 | 1705 |
| 5 | LSFVPVPDGK | 0.050 | 1706 |
| 4 | FLSFVPVPDG | 0.010 | 1707 |
| 1 | VDEFLSFVPV | 0.006 | 1708 |
| 6 | SFVPVPDGKG | 0.001 | 1709 |
| 2 | DEFLSFVPVP | 0.001 | 1710 |
| 3 | EFLSFVPVPD | 0.001 | 1711 |

TABLE XIX

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| ig | 19% | Immunoglobulin domain | domains are one hundred amino acids long and include a conserved intra-domain disulfide bond. |
| WD40 | 18% | WD domain, G-beta repeat | tandem repeats of about 40 residues, each containing a Trp—Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| pkinase | 23% | Protein kinase domain | conserved catalytic core common to both serine/threonine and tyrosine protein kinases containing an ATP binding site and a catalytic site |
| PH | 16% | PH domain | pleckstrin homology involved in intra-cellular signaling or as constituents of the cytoskeleton |
| EGF | 34% | EGF-like domain | 30–40 amino-acid long found in the extracellular domain of membrane-bound proteins or in secreted proteins |
| rvt | 49% | Reverse transcriptase (RNA-dependent DNA polymerase) | |
| ank | 25% | Ank repeat | Cytoplasmic protein, associates integral membrane proteins to the cytoskeleton |
| oxidored_q1 | 32% | NADH-Ubiquinone/plastoquinone (complex I), various chains | membrane associated. Involved in proton translocation across the membrane |

TABLE XIX-continued

Frequently Occurring Motifs

| Name | avrg. % identity | Description | Potential Function |
|---|---|---|---|
| efhand | 24% | EF hand | calcium-binding domain, consists of a 12 residue loop flanked on both sides by a 12 residue alpha-helical domain |
| rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G—X—Y and the polypeptide chains forms a triple helix. |
| fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic regions, with the N-terminus located extracellularly while the C-terminus is cytoplasmic. Signal through G proteins |

TABLE XX

Motifs and Post-translational Modifications of 184P1E2

N-glycosylation site

| | |
|---|---|
| 88–91 | NDSH |
| 315–318 | NNTC | cAMP- and cGMP-dependent protein kinase phosphorylation site

| | |
|---|---|
| 440–443 | RRvT |
| 578–581 | KKaT |

Protein kinase C phosphorylation site

| | |
|---|---|
| 65–67 | TrR |
| 370–372 | SpR |
| 438–440 | SgR |
| 533–535 | SnK |
| 575–577 | TeR |
| 656–658 | SfK |

Casein kinase II phosphorylation site

| | |
|---|---|
| 25–28 | TlvD |
| 32–35 | SvpE |
| 98–101 | SshE |
| 113–116 | TcvD |
| 204–207 | SsyD |
| 255–258 | SfpD |
| 270–273 | TllD |
| 275–278 | SneD |
| 402–405 | SglD |
| 533–536 | SnkD |
| 546–549 | SciD |
| 619–622 | SllE |
| 629–632 | TfiD |

TABLE XX-continued

Motifs and Post-translational Modifications of 184P1E2

N-myristoylation site

| | |
|---|---|
| 331–336 | GCklTI |
| 432–437 | GNlpGS |
| 560–565 | GLaeCD |
| 625–630 | GLhcTF |
| 647–652 | GTnvCR |

Amidation site

| | |
|---|---|
| 438–441 | sGRR |

| | Bioinformatic Program | Outcome |
|---|---|---|
| 184P1E2 v.1 | | |
| ORF | ORF finder | bp42-2036 (includes stop) |
| Protein length | | 664 aa |
| Transmembrane region | TM Pred | No TM |
| | HMMTop | no TM, N terminus extracellular |
| | Sosui | soluble protein |
| | TMHMM | no TM, extracellular |
| Signal Peptide | Signal P | none |
| pI | pI/MW tool | pI5.3 |
| Molecular weight | pI/MW tool | 74.7 kDa |
| Localization | PSORT | Mitochondrial matrix space 59%, mitochondrial inner membrane 29.9%, mitochondrial intermembrane space 29.9%, mitochondrial outer membrane 29.9% |
| | PSORT II | 47.8 cytoplasmic, 21.7% nuclear, 17.4% mitochondrial |
| Motifs | Pfam | Protein-arginine deiminase (PAD) |
| | Prints | Cadherin signature, FAD dependent pyridine nucleotide reductase signature, |
| | Blocks | G10 protein, urocanase, phosphoglycerate kinase family, developmental signaling protein Wntlfamily |
| 184P1E2 v.2 | | |
| ORF | ORF finder | bp42-2036 (includes stop) |
| Protein length | | 664 aa |
| Transmembrane region | TM Pred | no TM |
| | HMMTop | no TM, N terminus extracellular |
| | Sosui | soluble protein |
| | TMHMM | no TM, extracellular |
| Signal Peptide | Signal P | none |
| pI | pI/MW tool | pI5.3 |
| Molecular weight | pI/MW tool | 74.7 kDa |
| Localization | PSORT | Mitochondrial matrix space 59%, mitochondrial inner membrane 29.9%, mitochondrial intermembrane space 29.9%, mitochondrial outer membrane 29.9% |
| | PSORT II | 47.8% cytoplasmic, 21.7% nuclear, 17.4% mitochondrial |
| Motifs | Pfam | Protein-arginine deiminase (PAD) |
| | Prints | Cadherin signature, FAD dependent pyridine nucleotide reductase signature |
| | Blocks | G10 protein, urocanase, phosphoglycerate kinase family, developmental signaling protein Wntlfamily |
| 184P1E2 v.3 | | |
| ORF | ORF finder | bp42-2036 (includes stop) |
| Protein length | | 664 aa |
| Transmembrane region | TM Pred | no TM |
| | HMMTop | no TM, N terminus extracellular |
| | Sosui | soluble protein |
| | TMHMM | no TM, extracellular |
| Signal Peptide | Signal P | none |

| | Bioinformatic Program | Outcome |
|---|---|---|
| pI | pI/MW tool | pI5.3 |
| Molecular weight | pI/MW tool | 74.7 kDa |
| Localization | PSORT | Mitochondrial matrix space 59%, mitochondrial inner membrane 29.9%, mitochondrial intermembrane space 29.9%, mitochondrial outer membrane 29.9% |
| | PSORT II | 47.8 cytoplasmic, 21.7% nuclear, 17.4% mitochondrial |
| Motifs | Pfam | Protein-arginine deiminase (PAD) |
| | Prints | Cadherin signature, FAD dependent pyridine nucleotide reductase signature |
| | Blocks | G10 protein, urocanase, phospho-glycerate kinase family, developmental signaling protein Wntlfamily |

TABLE XXII

| Pos | 1 | 2 | 3 | 4 | 5 | 6 | 7 | 8 | 9 | score | SEQ. ID NO. |
|---|---|---|---|---|---|---|---|---|---|---|---|
| \multicolumn{12}{c}{184P1E2 v.1: HLA Peptide Scoring Results A1 9-mers SYFPEITHI} |
| 99 | S | H | E | P | L | P | L | A | Y | 37 | 1712 |
| 348 | I | Q | D | E | M | E | L | G | Y | 31 | 1713 |
| 301 | S | T | L | P | P | L | E | V | Y | 29 | 1714 |
| 218 | G | P | E | D | V | C | E | A | Y | 27 | 1715 |
| 373 | N | G | E | L | Q | D | F | P | Y | 27 | 1716 |
| 22 | G | V | E | T | L | V | D | I | Y | 26 | 1717 |
| 43 | Y | G | T | P | G | V | D | I | Y | 24 | 1718 |
| 532 | L | S | N | K | D | L | I | N | Y | 23 | 1719 |
| 620 | L | L | E | P | L | G | L | H | C | 22 | 1720 |
| 88 | N | D | S | H | V | Q | I | S | Y | 21 | 1721 |
| 236 | S | Y | E | V | P | R | L | H | G | 20 | 1722 |
| 285 | F | T | D | T | V | V | F | R | V | 20 | 1723 |
| 35 | E | G | T | E | M | F | E | V | Y | 19 | 1724 |
| 103 | L | P | L | A | Y | A | V | L | Y | 18 | 1725 |
| 629 | T | F | I | D | D | F | T | P | Y | 18 | 1726 |
| 138 | Q | W | V | W | G | P | S | G | Y | 17 | 1727 |
| 193 | L | F | D | D | H | K | L | V | L | 17 | 1728 |
| 229 | V | L | E | G | Q | D | K | V | S | Y | 17 | 1729 |
| 383 | R | I | L | G | P | D | F | G | Y | 17 | 1730 |
| 566 | I | I | D | I | P | Q | L | F | K | 17 | 1731 |
| 36 | G | T | E | M | F | E | V | Y | G | 16 | 1732 |
| 198 | K | L | V | L | H | T | S | S | Y | 16 | 1733 |
| 256 | F | P | D | A | G | F | T | G | L | 16 | 1734 |
| 415 | P | V | V | A | N | G | K | E | Y | 16 | 1735 |
| 574 | K | T | E | R | K | K | A | T | A | 16 | 1736 |
| 584 | F | P | D | L | V | N | M | L | V | 16 | 1737 |
| 156 | R | D | D | P | S | C | D | V | Q | 15 | 1738 |
| 319 | F | V | D | A | V | A | E | L | A | 15 | 1739 |
| 613 | L | E | E | K | V | R | S | L | L | 15 | 1740 |
| 10 | S | L | E | H | P | T | S | A | V | 14 | 1741 |
| 160 | S | C | D | V | Q | D | N | C | D | 14 | 1742 |
| 222 | V | C | E | A | Y | R | H | V | L | 14 | 1743 |
| 244 | G | D | E | E | R | F | F | V | E | 14 | 1744 |
| 265 | I | S | F | H | V | T | L | L | D | 14 | 1745 |
| 393 | T | R | E | P | R | D | R | S | V | 14 | 1746 |
| 403 | G | L | D | S | F | G | N | L | E | 14 | 1747 |
| 518 | V | D | D | E | Q | V | K | T | I | 14 | 1748 |
| 561 | L | A | E | C | D | I | I | D | I | 14 | 1749 |
| 563 | E | C | D | I | I | D | I | P | Q | 14 | 1750 |
| 26 | L | V | D | I | Y | G | S | V | P | 13 | 1751 |
| 44 | G | T | P | G | V | D | I | Y | I | 13 | 1752 |
| 55 | N | M | E | R | G | R | E | R | A | 13 | 1753 |
| 73 | T | L | E | I | I | V | V | M | N | 13 | 1754 |
| 118 | S | L | D | C | D | L | N | C | E | 13 | 1755 |
| 128 | R | Q | D | R | N | F | V | D | K | 13 | 1756 |
| 143 | P | S | G | Y | G | G | I | L | L | 13 | 1757 |
| 144 | S | G | Y | G | G | I | L | L | V | 13 | 1758 |
| 194 | F | D | D | H | K | L | V | L | H | 13 | 1759 |

TABLE XXII-continued

| Pos | 1 | 2 | 3 | 4 | 5 | 6 | 7 | 8 | 9 | score | SEQ. ID NO. |
|---|---|---|---|---|---|---|---|---|---|---|---|
| 205 | S | Y | D | A | K | R | A | Q | V | 13 | 1760 |
| 245 | D | E | E | R | F | F | V | E | G | 13 | 1761 |
| 305 | P | L | E | V | Y | V | C | R | V | 13 | 1762 |
| 362 | K | T | L | P | V | V | F | D | S | 13 | 1763 |
| 367 | V | F | D | S | P | R | N | G | E | 13 | 1764 |
| 455 | V | Q | P | P | V | E | L | F | V | 13 | 1765 |
| 480 | A | P | D | G | K | G | F | R | M | 13 | 1766 |
| 500 | F | Q | E | K | Q | K | C | G | H | 13 | 1767 |
| 517 | V | V | D | D | E | Q | V | K | T | 13 | 1768 |
| 526 | I | S | I | N | Q | V | L | S | N | 13 | 1769 |
| 634 | F | T | P | Y | H | M | L | H | G | 13 | 1770 |
| 33 | V | P | E | G | T | E | M | F | E | 12 | 1771 |
| 39 | M | F | E | V | Y | G | T | P | G | 12 | 1772 |
| 84 | S | N | D | L | N | D | S | H | V | 12 | 1773 |
| 133 | F | V | D | K | R | Q | W | V | W | 12 | 1774 |
| 176 | D | L | E | D | M | S | V | M | V | 12 | 1775 |
| 177 | L | E | D | M | S | V | M | V | L | 12 | 1776 |
| 231 | G | Q | D | K | V | S | Y | E | V | 12 | 1777 |
| 250 | F | V | E | G | L | S | F | P | D | 12 | 1778 |
| 271 | L | L | D | D | S | N | E | D | F | 12 | 1779 |
| 275 | S | N | E | D | F | S | A | S | P | 12 | 1780 |
| 323 | V | A | E | L | A | R | K | A | G | 12 | 1781 |
| 351 | E | M | E | L | G | Y | V | Q | A | 12 | 1782 |
| 386 | G | P | D | F | G | Y | V | T | R | 12 | 1783 |
| 409 | N | L | E | V | S | P | P | V | V | 12 | 1784 |
| 412 | V | S | P | P | V | V | A | N | G | 12 | 1785 |
| 471 | V | D | E | F | L | S | F | V | P | 12 | 1786 |
| 519 | D | D | E | Q | V | K | T | I | S | 12 | 1787 |
| 547 | C | I | D | W | N | R | E | V | L | 12 | 1788 |
| 556 | K | R | E | L | G | L | A | E | C | 12 | 1789 |
| 612 | C | L | E | E | K | V | R | S | L | 12 | 1790 |
| 47 | G | V | D | I | Y | I | S | P | N | 11 | 1791 |
| 62 | R | A | D | T | R | R | W | R | F | 11 | 1792 |
| 87 | L | N | D | S | H | V | Q | I | S | 11 | 1793 |
| 124 | N | C | E | G | R | Q | D | R | N | 11 | 1794 |
| 155 | D | R | D | D | P | S | C | D | V | 11 | 1795 |
| 163 | V | Q | D | N | C | D | Q | H | V | 11 | 1796 |
| 166 | N | C | D | Q | H | V | H | C | L | 11 | 1797 |
| 243 | H | G | D | E | E | R | F | F | V | 11 | 1798 |
| 300 | P | S | T | L | P | P | L | E | V | 11 | 1799 |
| 339 | Q | A | E | N | R | N | D | R | W | 11 | 1800 |
| 376 | L | Q | D | F | P | Y | K | R | I | 11 | 1801 |
| 396 | P | R | D | R | S | V | S | G | L | 11 | 1802 |
| 420 | G | K | E | Y | P | L | G | R | I | 11 | 1803 |
| 428 | I | L | I | G | G | N | L | P | G | 11 | 1804 |
| 446 | V | R | D | F | L | H | A | Q | K | 11 | 1805 |
| 458 | P | V | E | L | F | V | D | W | L | 11 | 1806 |
| 462 | F | V | D | W | L | A | V | G | H | 11 | 1807 |
| 534 | N | K | D | L | I | N | Y | N | K | 11 | 1808 |
| 630 | F | I | D | D | F | T | P | Y | H | 11 | 1809 |
| 59 | G | R | E | R | A | D | T | R | R | 10 | 1810 |
| 69 | R | F | D | A | T | L | E | I | I | 10 | 1811 |
| 81 | N | S | P | S | N | D | L | N | D | 10 | 1812 |
| 97 | H | S | S | H | E | P | L | P | L | 10 | 1813 |
| 114 | C | D | D | I | S | L | D | C | D | 10 | 1814 |
| 117 | I | S | L | D | C | D | L | N | C | 10 | 1815 |
| 120 | D | C | D | L | N | C | E | G | R | 10 | 1816 |
| 153 | N | C | D | R | D | D | P | S | C | 10 | 1817 |
| 174 | L | Q | D | L | E | D | M | S | V | 10 | 1818 |
| 186 | R | T | Q | G | P | A | A | L | F | 10 | 1819 |
| 187 | T | Q | G | P | A | A | L | F | D | 10 | 1820 |
| 219 | P | E | D | V | C | E | A | Y | R | 10 | 1821 |
| 272 | L | D | D | S | N | E | D | F | S | 10 | 1822 |
| 276 | N | E | D | F | S | A | S | P | I | 10 | 1823 |
| 297 | I | M | T | P | S | T | L | P | P | 10 | 1824 |
| 343 | R | N | D | R | W | I | Q | D | E | 10 | 1825 |
| 349 | Q | D | E | M | E | L | G | Y | V | 10 | 1826 |
| 370 | S | P | R | N | G | E | L | Q | D | 10 | 1827 |
| 442 | V | T | Q | V | V | R | D | F | L | 10 | 1828 |
| 470 | H | V | D | E | F | L | S | F | V | 10 | 1829 |
| 551 | N | R | E | V | L | K | R | E | L | 10 | 1830 |
| 618 | R | S | L | L | E | P | L | G | L | 10 | 1831 |
| 631 | I | D | D | F | T | P | Y | H | M | 10 | 1832 |
| 641 | H | G | E | V | H | C | G | T | N | 10 | 1833 |
| 31 | G | S | V | P | E | G | T | E | M | 9 | 1834 |
| 98 | S | S | H | E | P | L | P | L | A | 9 | 1835 |

TABLE XXII-continued

| Pos | 1 | 2 | 3 | 4 | 5 | 6 | 7 | 8 | 9 | score | SEQ. ID NO. |
|---|---|---|---|---|---|---|---|---|---|---|---|
| 111 | Y | L | T | C | V | D | I | S | L | 9 | 1836 |
| 171 | V | H | C | L | Q | D | L | E | D | 9 | 1837 |
| 202 | H | T | S | S | Y | D | A | K | R | 9 | 1838 |
| 235 | V | S | Y | E | V | P | R | L | H | 9 | 1839 |
| 280 | S | A | S | P | I | F | T | D | T | 9 | 1840 |
| 316 | N | T | C | F | V | D | A | V | A | 9 | 1841 |
| 392 | V | T | R | E | P | R | D | R | S | 9 | 1842 |
| 404 | L | D | S | F | G | N | L | E | V | 9 | 1843 |
| 422 | E | Y | P | L | G | R | I | L | I | 9 | 1844 |
| 423 | Y | P | L | G | R | I | L | I | G | 9 | 1845 |
| 444 | Q | V | V | R | D | F | L | H | A | 9 | 1846 |
| 469 | G | H | V | D | E | F | L | S | F | 9 | 1847 |
| 506 | C | G | H | G | R | A | L | L | F | 9 | 1848 |
| 549 | D | W | N | R | E | V | L | K | R | 9 | 1849 |
| 580 | A | T | A | F | F | P | D | L | V | 9 | 1850 |
| 5 | R | I | V | R | V | S | L | E | H | 8 | 1851 |
| 14 | P | T | S | A | V | C | V | A | G | 8 | 1852 |
| 20 | V | A | G | V | E | T | L | V | D | 8 | 1853 |
| 72 | A | T | L | E | I | I | V | V | M | 8 | 1854 |
| 104 | P | L | A | Y | A | V | L | Y | L | 8 | 1855 |
| 112 | L | T | C | V | D | I | S | L | D | 8 | 1856 |
| 145 | G | Y | G | G | I | L | L | V | N | 8 | 1857 |
| 254 | L | S | F | P | D | A | G | F | T | 8 | 1858 |
| 266 | S | F | H | V | T | L | L | D | D | 8 | 1859 |
| 384 | I | L | G | P | P | D | F | G | Y | V | 8 | 1860 |
| 454 | K | V | Q | P | P | V | E | L | F | 8 | 1861 |
| 483 | G | K | G | F | R | M | L | L | A | 8 | 1862 |
| 491 | A | S | P | G | A | C | F | K | L | 8 | 1863 |
| 524 | K | T | I | S | I | N | Q | V | L | 8 | 1864 |
| 531 | V | L | S | N | K | D | L | I | N | 8 | 1865 |
| 567 | I | D | I | P | Q | L | F | K | T | 8 | 1866 |
| 581 | T | A | F | F | P | D | L | V | N | 8 | 1867 |
| 614 | E | E | K | V | R | S | L | L | E | 8 | 1868 |
| 625 | G | L | H | C | T | F | I | D | D | 8 | 1869 |
| 23 | V | E | T | L | V | D | I | Y | G | 7 | 1870 |
| 64 | D | T | R | R | W | R | F | D | A | 7 | 1871 |
| 80 | M | N | S | P | S | N | D | L | N | 7 | 1872 |
| 106 | A | Y | A | V | L | Y | L | T | C | 7 | 1873 |
| 179 | D | M | S | V | M | V | L | R | T | 7 | 1874 |
| 195 | D | D | H | K | L | V | L | H | T | 7 | 1875 |
| 224 | E | A | Y | R | H | V | L | G | Q | 7 | 1876 |
| 248 | R | F | F | V | E | G | L | S | F | 7 | 1877 |
| 258 | D | A | G | F | T | G | L | I | S | 7 | 1878 |
| 259 | A | G | F | T | G | L | I | S | F | 7 | 1879 |
| 261 | F | T | G | L | I | S | F | H | V | 7 | 1880 |
| 269 | V | T | L | L | D | D | S | N | E | 7 | 1881 |
| 274 | D | S | N | E | D | F | S | A | S | 7 | 1882 |
| 287 | D | T | V | V | F | R | V | A | P | 7 | 1883 |
| 291 | F | R | V | A | P | W | I | M | T | 7 | 1884 |
| 320 | V | D | A | V | A | E | L | A | R | 7 | 1885 |
| 328 | R | K | A | G | C | K | L | T | I | 7 | 1886 |
| 334 | L | T | I | C | P | Q | A | E | N | 7 | 1887 |
| 357 | V | Q | A | P | H | K | T | L | P | 7 | 1888 |
| 369 | D | S | P | R | N | G | E | L | Q | 7 | 1889 |
| 378 | D | F | P | Y | K | R | I | L | Q | 7 | 1890 |
| 379 | F | P | Y | K | R | I | L | G | P | 7 | 1891 |
| 398 | D | R | S | V | S | G | L | D | S | 7 | 1892 |
| 419 | N | G | K | E | Y | P | L | G | R | 7 | 1893 |
| 437 | S | S | G | R | R | V | T | Q | V | 7 | 1894 |
| 460 | E | L | F | V | D | W | L | A | V | 7 | 1895 |
| 492 | S | P | G | A | C | F | K | L | F | 7 | 1896 |
| 555 | L | K | R | E | L | G | L | A | E | 7 | 1897 |
| 585 | P | D | L | V | N | M | L | V | L | 7 | 1898 |
| 587 | L | V | N | M | L | V | L | G | K | 7 | 1899 |
| 591 | L | V | L | G | K | H | L | G | I | 7 | 1900 |
| 633 | D | F | T | P | Y | H | M | L | H | 7 | 1901 |
| 647 | E | T | N | V | C | R | K | P | F | 7 | 1902 |
| 24 | E | T | L | V | D | I | Y | G | S | 6 | 1903 |
| 51 | Y | I | S | P | N | M | E | R | G | 6 | 1904 |
| 68 | W | R | F | D | A | T | L | E | I | 6 | 1905 |
| 89 | D | S | H | V | Q | I | S | Y | H | 6 | 1906 |
| 113 | T | C | V | D | I | S | L | D | C | 6 | 1907 |
| 140 | V | W | G | P | S | G | Y | G | G | 6 | 1908 |
| 159 | P | S | C | D | V | Q | D | N | C | 6 | 1909 |
| 168 | D | Q | H | V | H | C | L | Q | D | 6 | 1910 |
| 180 | M | S | V | M | V | L | R | T | Q | 6 | 1911 |
| 204 | S | S | Y | D | A | K | R | A | Q | 6 | 1912 |
| 237 | Y | E | V | P | R | L | H | G | D | 6 | 1913 |
| 279 | F | S | A | S | P | I | F | T | D | 6 | 1914 |
| 286 | T | D | T | V | V | F | R | V | A | 6 | 1915 |
| 298 | M | T | P | S | T | L | P | P | L | 6 | 1916 |
| 335 | T | I | C | P | Q | A | E | N | R | 6 | 1917 |
| 358 | Q | A | P | H | K | T | L | P | V | 6 | 1918 |
| 363 | T | L | P | V | V | F | D | S | P | 6 | 1919 |
| 368 | F | D | S | P | R | N | G | E | L | 6 | 1920 |
| 399 | R | S | V | S | G | L | D | S | F | 6 | 1921 |
| 405 | D | S | F | G | N | L | E | V | S | 6 | 1922 |
| 411 | E | V | S | P | P | V | V | A | N | 6 | 1923 |
| 432 | G | N | L | P | G | S | S | G | R | 6 | 1924 |
| 436 | G | S | S | G | R | R | V | T | Q | 6 | 1925 |
| 476 | S | F | V | P | A | P | D | G | K | 6 | 1926 |
| 478 | V | P | A | P | D | G | K | G | F | 6 | 1927 |
| 481 | P | D | G | K | G | F | R | M | L | 6 | 1928 |
| 484 | K | G | F | R | M | L | L | A | S | 6 | 1929 |
| 490 | L | A | S | P | G | A | C | F | K | 6 | 1930 |
| 493 | P | G | A | C | F | K | L | F | Q | 6 | 1931 |
| 507 | G | H | G | R | A | L | L | F | Q | 6 | 1932 |
| 511 | A | L | L | F | Q | G | V | D | D | 6 | 1933 |
| 553 | E | V | L | K | R | E | L | G | L | 6 | 1934 |
| 600 | P | K | P | F | G | P | I | I | N | 6 | 1935 |
| 601 | K | P | F | G | P | I | I | N | G | 6 | 1936 |
| 607 | I | N | G | C | C | C | L | E | E | 6 | 1937 |
| 615 | E | K | V | R | S | L | L | E | P | 6 | 1938 |
| 619 | S | L | L | E | P | L | G | L | H | 6 | 1939 |
| 628 | C | T | F | I | D | D | F | T | P | 6 | 1940 |
| 651 | C | R | K | P | F | S | F | K | W | 6 | 1941 |
| 655 | F | S | F | K | W | W | N | M | V | 6 | 1942 |
| 2 | S | L | Q | R | I | V | R | V | S | 5 | 1943 |
| 9 | V | S | L | E | H | P | T | S | A | 5 | 1944 |
| 11 | L | E | H | P | T | S | A | V | C | 5 | 1945 |
| 15 | T | S | A | V | C | V | A | G | V | 5 | 1946 |
| 16 | S | A | V | C | V | A | G | V | E | 5 | 1947 |
| 19 | C | V | A | G | V | E | T | L | V | 5 | 1948 |
| 32 | S | V | P | E | G | T | E | M | F | 5 | 1949 |
| 70 | F | D | A | T | L | E | I | I | V | 5 | 1950 |
| 71 | D | A | T | L | E | I | I | V | V | 5 | 1951 |
| 83 | P | S | N | D | L | N | D | S | H | 5 | 1952 |
| 184 | V | L | R | T | Q | G | P | A | A | 5 | 1953 |
| 209 | K | R | A | Q | V | F | H | I | C | 5 | 1954 |
| 281 | A | S | P | I | F | T | D | T | V | 5 | 1955 |
| 302 | T | L | P | P | L | E | V | Y | V | 5 | 1956 |
| 309 | Y | V | C | R | V | R | N | N | T | 5 | 1957 |
| 327 | A | R | K | A | G | C | K | L | T | 5 | 1958 |
| 330 | A | G | C | K | L | T | I | C | P | 5 | 1959 |
| 377 | Q | D | F | P | Y | K | R | I | L | 5 | 1960 |
| 401 | V | S | G | L | D | S | F | G | N | 5 | 1961 |
| 402 | S | G | L | D | S | F | G | N | L | 5 | 1962 |
| 421 | K | E | Y | P | L | G | R | I | L | 5 | 1963 |
| 424 | P | L | G | R | I | L | I | G | G | 5 | 1964 |
| 427 | R | I | L | I | G | G | N | L | P | 5 | 1965 |
| 438 | S | G | R | R | V | T | Q | V | V | 5 | 1966 |
| 459 | V | E | L | F | V | D | W | L | A | 5 | 1967 |
| 475 | L | S | F | V | P | A | P | D | G | 5 | 1968 |
| 505 | K | C | G | H | G | R | A | L | L | 5 | 1969 |
| 560 | G | L | A | E | C | D | I | I | D | 5 | 1970 |
| 582 | A | F | F | P | D | L | V | N | M | 5 | 1971 |
| 588 | V | N | M | L | V | L | G | K | H | 5 | 1972 |
| 590 | M | L | V | L | G | K | H | L | G | 5 | 1973 |
| 593 | L | G | K | H | L | G | I | P | K | 5 | 1974 |
| 599 | I | P | K | P | F | G | P | I | I | 5 | 1975 |
| 650 | V | C | R | K | P | F | S | F | K | 5 | 1976 |
| 1 | M | S | L | Q | R | I | V | R | V | 4 | 1977 |
| 18 | V | C | V | A | G | V | E | T | L | 4 | 1978 |
| 46 | P | A | V | D | I | Y | I | S | P | 4 | 1979 |
| 52 | I | S | P | N | M | E | R | G | R | 4 | 1980 |
| 94 | I | S | Y | H | S | S | H | E | P | 4 | 1981 |
| 96 | Y | H | S | S | H | E | P | L | P | 4 | 1982 |
| 101 | E | P | L | P | L | A | Y | A | V | 4 | 1983 |
| 105 | L | A | Y | A | V | L | Y | L | T | 4 | 1984 |

TABLE XXII-continued

| Pos | 1 | 2 | 3 | 4 | 5 | 6 | 7 | 8 | 9 | score | SEQ. ID NO. |
|---|---|---|---|---|---|---|---|---|---|---|---|
| 167 | C | D | Q | H | V | H | C | L | Q | 4 | 1985 |
| 178 | E | D | M | S | V | M | V | L | R | 4 | 1986 |
| 192 | A | L | F | D | D | H | K | L | V | 4 | 1987 |
| 203 | T | S | S | Y | D | A | K | R | A | 4 | 1988 |
| 208 | A | K | R | A | Q | V | F | H | I | 4 | 1989 |
| 210 | R | A | Q | V | F | H | I | C | Q | 4 | 1990 |
| 216 | I | C | G | P | E | D | V | C | E | 4 | 1991 |
| 227 | R | H | V | L | G | Q | D | K | V | 4 | 1992 |
| 228 | H | V | L | G | Q | D | K | V | S | 4 | 1993 |
| 247 | E | R | F | F | V | E | G | L | S | 4 | 1994 |
| 251 | V | E | G | L | S | F | P | D | A | 4 | 1995 |
| 262 | T | G | L | I | S | F | H | V | T | 4 | 1996 |
| 278 | D | F | S | A | S | P | I | F | T | 4 | 1997 |
| 292 | R | V | A | P | W | I | M | T | P | 4 | 1998 |
| 342 | N | R | N | D | R | W | I | Q | D | 4 | 1999 |
| 397 | R | D | R | S | V | S | G | L | D | 4 | 2000 |
| 413 | S | P | P | V | V | A | N | G | K | 4 | 2001 |
| 435 | P | G | S | S | G | R | R | V | T | 4 | 2002 |
| 449 | F | L | H | A | Q | K | V | Q | P | 4 | 2003 |
| 452 | A | Q | K | V | Q | P | P | V | E | 4 | 2004 |
| 464 | D | W | L | A | V | G | H | V | D | 4 | 2005 |
| 474 | F | L | S | F | V | P | A | P | D | 4 | 2006 |
| 477 | F | V | P | A | P | D | G | K | G | 4 | 2007 |
| 482 | D | G | K | G | F | R | M | L | L | 4 | 2008 |
| 495 | A | C | F | K | L | F | Q | E | K | 4 | 2009 |
| 512 | L | L | F | Q | G | V | V | D | D | 4 | 2010 |
| 513 | L | F | Q | G | V | V | D | D | E | 4 | 2011 |
| 520 | D | E | Q | V | K | T | I | S | I | 4 | 2012 |
| 522 | Q | V | K | T | I | S | I | N | Q | 4 | 2013 |
| 527 | S | I | N | Q | V | L | S | N | K | 4 | 2014 |
| 540 | Y | N | K | F | V | Q | S | C | I | 4 | 2015 |
| 542 | K | F | V | Q | S | C | I | D | W | 4 | 2016 |
| 545 | Q | S | C | I | D | W | N | R | E | 4 | 2017 |
| 554 | V | L | K | R | E | L | G | L | A | 4 | 2018 |
| 594 | G | K | H | L | G | I | P | K | P | 4 | 2019 |
| 597 | L | G | I | P | K | P | F | G | P | 4 | 2020 |
| 598 | G | I | P | K | P | F | G | P | I | 4 | 2021 |
| 602 | P | F | G | P | I | I | N | G | C | 4 | 2022 |
| 637 | Y | H | M | L | H | G | E | V | H | 4 | 2023 |
| 646 | C | G | T | N | V | C | R | K | P | 4 | 2024 |
| 656 | S | F | K | W | W | N | M | V | P | 4 | 2025 |
| 3 | L | Q | R | I | V | R | V | S | L | 3 | 2026 |
| 4 | Q | R | I | V | R | V | S | L | E | 3 | 2027 |
| 27 | V | D | I | Y | G | S | V | P | E | 3 | 2028 |
| 30 | Y | G | S | V | P | E | G | T | E | 3 | 2029 |
| 40 | F | E | V | Y | G | T | P | G | V | 3 | 2030 |
| 42 | V | Y | G | T | P | G | V | D | I | 3 | 2031 |
| 53 | S | P | N | M | E | R | G | R | E | 3 | 2032 |
| 65 | T | R | R | W | R | F | D | A | T | 3 | 2033 |
| 74 | L | E | I | I | V | V | M | N | S | 3 | 2034 |
| 107 | Y | A | V | L | Y | L | T | C | V | 3 | 2035 |
| 123 | L | N | C | E | G | R | Q | D | R | 3 | 2036 |
| 129 | Q | D | R | N | F | V | D | K | R | 3 | 2037 |
| 134 | V | D | K | R | Q | W | V | W | G | 3 | 2038 |
| 142 | G | P | S | G | Y | G | G | I | L | 3 | 2039 |
| 148 | G | I | L | L | V | N | C | D | R | 3 | 2040 |
| 181 | S | V | M | V | L | R | T | Q | G | 3 | 2041 |
| 189 | G | P | A | A | L | F | D | D | H | 3 | 2042 |
| 191 | A | A | L | F | D | D | H | K | L | 3 | 2043 |
| 206 | Y | D | A | K | R | A | Q | V | F | 3 | 2044 |
| 214 | F | H | I | C | G | P | E | D | V | 3 | 2045 |
| 215 | H | I | C | G | P | E | D | V | C | 3 | 2046 |
| 225 | A | Y | R | H | V | L | G | Q | D | 3 | 2047 |
| 226 | Y | R | H | V | L | G | Q | D | K | 3 | 2048 |
| 249 | F | F | V | E | G | L | S | F | P | 3 | 2049 |
| 255 | S | F | P | D | A | G | F | T | G | 3 | 2050 |
| 257 | P | D | A | G | F | T | G | L | I | 3 | 2051 |
| 264 | L | I | S | F | H | V | T | L | L | 3 | 2052 |
| 282 | S | P | I | F | T | D | T | V | V | 3 | 2053 |
| 289 | V | V | F | R | V | A | P | W | I | 3 | 2054 |
| 296 | W | I | M | T | P | S | T | V | R | 3 | 2055 |
| 306 | L | E | V | Y | Y | F | R | V | R | 3 | 2056 |
| 314 | R | N | N | T | C | F | V | D | A | 3 | 2057 |
| 322 | A | V | A | E | L | A | R | K | A | 3 | 2058 |
| 326 | L | A | R | K | A | G | C | K | L | 3 | 2059 |
| 345 | D | R | W | I | Q | D | E | M | E | 3 | 2060 |
| 352 | M | E | L | G | Y | V | Q | A | P | 3 | 2061 |
| 353 | E | L | G | Y | V | Q | A | P | H | 3 | 2062 |
| 356 | Y | V | Q | A | P | H | K | T | L | 3 | 2063 |
| 374 | G | E | L | Q | D | F | P | Y | K | 3 | 2064 |
| 375 | E | L | Q | D | F | P | Y | K | R | 3 | 2065 |
| 381 | Y | K | R | I | L | G | P | D | F | 3 | 2066 |
| 387 | P | D | F | G | Y | V | T | R | E | 3 | 2067 |
| 400 | S | V | S | G | L | D | S | F | G | 3 | 2068 |
| 414 | P | P | V | V | A | N | G | K | E | 3 | 2069 |
| 416 | V | V | A | N | G | K | E | Y | P | 3 | 2070 |
| 418 | A | N | G | K | E | Y | P | L | G | 3 | 2071 |
| 440 | R | R | V | T | Q | V | V | R | D | 3 | 2072 |
| 441 | R | V | T | Q | V | V | R | D | F | 3 | 2073 |
| 457 | P | P | V | E | L | F | V | D | W | 3 | 2074 |
| 465 | W | L | A | V | G | H | V | D | E | 3 | 2075 |
| 467 | A | V | G | H | V | D | E | F | L | 3 | 2076 |
| 468 | V | G | H | V | D | E | F | L | S | 3 | 2077 |
| 472 | D | E | F | L | S | F | V | P | A | 3 | 2078 |
| 489 | L | L | A | S | P | G | A | C | F | 3 | 2079 |
| 497 | F | K | L | F | Q | E | K | Q | K | 3 | 2080 |
| 498 | K | L | F | Q | E | K | Q | K | C | 3 | 2081 |
| 509 | G | R | A | L | L | F | Q | G | V | 3 | 2082 |
| 514 | F | Q | G | V | V | D | D | E | Q | 3 | 2083 |
| 536 | D | L | I | N | Y | N | K | F | V | 3 | 2084 |
| 538 | I | N | Y | N | K | F | V | Q | S | 3 | 2085 |
| 546 | S | C | I | D | W | N | R | E | V | 3 | 2086 |
| 552 | R | E | V | L | K | R | E | L | G | 3 | 2087 |
| 568 | D | I | P | Q | L | F | K | T | E | 3 | 2088 |
| 571 | Q | L | F | K | T | E | R | K | K | 3 | 2089 |
| 572 | L | F | K | T | E | R | K | K | A | 3 | 2090 |
| 578 | K | K | A | T | A | F | F | P | D | 3 | 2091 |
| 579 | K | A | T | A | F | F | P | D | L | 3 | 2092 |
| 583 | F | F | P | D | L | V | N | M | L | 3 | 2093 |
| 586 | D | L | V | N | M | L | V | L | G | 3 | 2094 |
| 606 | I | I | N | G | C | C | C | L | E | 3 | 2095 |
| 617 | V | R | S | L | L | E | P | L | G | 3 | 2096 |
| 639 | M | L | H | G | E | V | H | C | G | 3 | 2097 |
| 643 | E | V | H | C | G | T | N | V | C | 3 | 2098 |
| 644 | V | H | C | G | T | N | V | C | R | 3 | 2099 |
| 652 | R | K | P | F | S | F | K | W | W | 3 | 2100 |
| 13 | H | P | T | S | A | V | C | V | A | 2 | 2101 |
| 17 | A | V | C | V | A | G | V | E | T | 2 | 2102 |
| 28 | D | I | Y | G | S | V | P | E | G | 2 | 2103 |
| 29 | I | Y | G | S | V | P | E | G | T | 2 | 2104 |
| 38 | E | M | F | E | V | Y | G | T | P | 2 | 2105 |
| 41 | E | V | Y | G | T | P | G | V | D | 2 | 2106 |
| 50 | I | Y | I | S | P | N | M | E | R | 2 | 2107 |
| 67 | R | W | R | F | D | A | T | L | R | 2 | 2108 |
| 75 | E | I | I | V | V | M | N | S | P | 2 | 2109 |
| 79 | V | M | N | S | P | S | N | D | L | 2 | 2110 |
| 82 | S | P | S | N | D | L | N | D | S | 2 | 2111 |
| 90 | S | H | V | Q | I | S | Y | H | S | 2 | 2112 |
| 92 | V | Q | I | S | Y | H | S | S | H | 2 | 2113 |
| 95 | S | Y | H | S | S | H | E | P | L | 2 | 2114 |
| 102 | P | L | P | L | A | Y | A | V | L | 2 | 2115 |
| 108 | A | V | L | Y | L | T | C | V | D | 2 | 2116 |
| 109 | V | L | Y | L | T | C | V | D | I | 2 | 2117 |
| 116 | D | I | S | L | D | C | D | L | N | 2 | 2118 |
| 122 | D | L | N | C | E | G | R | Q | D | 2 | 2119 |
| 125 | C | E | G | R | Q | D | R | N | F | 2 | 2120 |
| 127 | G | R | Q | D | R | N | F | V | D | 2 | 2121 |
| 130 | D | R | N | F | V | D | K | R | Q | 2 | 2122 |
| 136 | K | P | S | N | D | L | N | G | P | 2 | 2123 |
| 139 | W | V | W | G | P | S | G | Y | G | 2 | 2124 |
| 141 | W | G | P | S | G | Y | G | G | I | 2 | 2125 |
| 146 | Y | G | G | I | L | L | V | N | C | 2 | 2126 |
| 165 | D | N | C | D | Q | H | V | H | C | 2 | 2127 |
| 170 | H | V | H | C | L | Q | D | L | E | 2 | 2128 |
| 173 | C | L | Q | D | L | E | D | M | S | 2 | 2129 |
| 185 | L | R | T | Q | G | P | A | A | L | 2 | 2130 |
| 196 | D | H | K | L | V | A | H | T | S | 2 | 2131 |
| 200 | V | H | T | S | S | Y | P | D | A | 2 | 2132 |
| 213 | V | F | H | I | C | G | P | E | D | 2 | 2133 |
| 223 | C | E | A | Y | R | H | V | L | G | 2 | 2134 |
| 239 | V | P | R | L | H | G | D | E | E | 2 | 2135 |
| 240 | P | R | L | H | G | D | E | E | R | 2 | 2136 |

TABLE XXII-continued

| Pos | 1 | 2 | 3 | 4 | 5 | 6 | 7 | 8 | 9 | score | SEQ. ID NO. |
|---|---|---|---|---|---|---|---|---|---|---|---|
| 241 | R | L | H | G | D | E | E | R | F | 2 | 2137 |
| 253 | G | L | S | F | P | D | A | G | F | 2 | 2138 |
| 299 | T | P | S | T | L | P | P | L | E | 2 | 2139 |
| 303 | L | P | P | L | E | V | Y | V | C | 2 | 2140 |
| 304 | P | P | L | E | V | V | C | R | | 2 | 2141 |
| 308 | V | Y | V | C | R | V | R | N | N | 2 | 2142 |
| 310 | V | C | R | V | R | N | N | T | C | 2 | 2143 |
| 313 | V | R | N | N | T | C | F | V | D | 2 | 2144 |
| 347 | W | I | Q | D | E | M | E | L | G | 2 | 2145 |
| 350 | D | E | M | E | L | G | Y | V | Q | 2 | 2146 |
| 354 | L | G | Y | V | Q | A | P | H | K | 2 | 2147 |
| 355 | G | Y | V | Q | A | P | H | K | T | 2 | 2148 |
| 359 | A | P | H | K | T | L | P | V | V | 2 | 2149 |
| 361 | H | K | T | L | P | V | V | F | D | 2 | 2150 |
| 382 | K | R | I | L | G | P | D | F | G | 2 | 2151 |
| 385 | L | G | P | D | F | G | Y | V | T | 2 | 2152 |
| 388 | D | F | G | Y | V | T | R | E | P | 2 | 2153 |
| 389 | F | G | Y | V | T | R | E | P | R | 2 | 2154 |
| 391 | Y | V | T | R | E | P | R | D | R | 2 | 2155 |
| 394 | R | E | P | R | D | R | S | V | S | 2 | 2156 |
| 406 | S | E | G | N | L | E | V | S | P | 2 | 2157 |
| 407 | F | G | N | L | E | V | S | P | P | 2 | 2158 |
| 408 | G | N | L | E | V | S | P | P | V | 2 | 2159 |
| 410 | L | E | V | S | P | P | V | V | A | 2 | 2160 |
| 417 | V | A | N | G | K | E | Y | P | L | 2 | 2161 |
| 431 | G | G | N | L | P | G | S | S | G | 2 | 2162 |
| 433 | N | L | P | G | S | S | G | R | R | 2 | 2163 |
| 443 | T | Q | V | V | R | D | F | L | H | 2 | 2164 |
| 447 | R | D | F | L | H | A | Q | K | V | 2 | 2165 |
| 451 | H | A | Q | K | V | Q | P | P | V | 2 | 2166 |
| 463 | V | D | W | L | A | V | G | H | V | 2 | 2167 |
| 466 | L | A | V | G | H | V | D | E | F | 2 | 2168 |
| 479 | P | A | P | D | G | K | G | F | R | 2 | 2169 |
| 496 | C | F | K | L | F | Q | E | K | Q | 2 | 2170 |
| 503 | K | Q | K | C | G | H | G | R | A | 2 | 2171 |
| 504 | Q | K | C | G | H | G | R | A | L | 2 | 2172 |
| 525 | T | I | S | I | N | Q | V | L | S | 2 | 2173 |
| 528 | I | N | Q | V | L | S | N | K | D | 2 | 2174 |
| 530 | Q | V | L | S | N | K | D | L | I | 2 | 2175 |
| 533 | S | N | K | D | L | I | N | Y | N | 2 | 2176 |
| 535 | K | D | L | I | N | Y | N | K | F | 2 | 2177 |
| 541 | N | K | F | V | Q | S | C | I | D | 2 | 2178 |
| 548 | I | D | W | N | R | E | V | L | K | 2 | 2179 |
| 550 | W | N | R | E | V | L | K | R | E | 2 | 2180 |
| 565 | D | I | I | D | I | P | Q | L | F | 2 | 2181 |
| 592 | V | L | G | K | H | L | G | I | P | 2 | 2182 |
| 596 | H | L | G | I | P | K | P | F | G | 2 | 2183 |
| 603 | F | G | P | I | I | N | G | C | C | 2 | 2184 |
| 605 | P | I | I | N | G | C | C | C | L | 2 | 2185 |
| 609 | G | C | C | C | L | E | E | K | V | 2 | 2186 |
| 621 | L | E | P | L | G | L | H | C | T | 2 | 2187 |
| 632 | D | D | F | T | P | Y | H | M | L | 2 | 2188 |
| 638 | H | M | L | H | G | E | V | H | C | 2 | 2189 |
| 640 | L | H | G | E | V | H | C | G | T | 2 | 2190 |
| 7 | V | R | V | S | L | E | H | P | T | 1 | 2191 |
| 21 | A | G | V | E | T | L | V | D | I | 1 | 2192 |
| 25 | T | L | V | D | I | Y | G | S | V | 1 | 2193 |
| 37 | T | E | M | F | E | V | Y | G | T | 1 | 2194 |
| 48 | V | D | I | Y | I | S | P | N | M | 1 | 2195 |
| 49 | D | I | Y | I | S | P | N | M | E | 1 | 2196 |
| 54 | P | N | M | E | R | G | R | E | R | 1 | 2197 |
| 56 | M | E | R | G | R | E | R | A | D | 1 | 2198 |
| 57 | E | R | G | R | E | R | A | D | T | 1 | 2199 |
| 61 | E | R | A | D | T | R | R | W | R | 1 | 2200 |
| 63 | A | D | T | R | R | W | R | F | D | 1 | 2201 |
| 76 | I | I | V | V | M | N | S | P | S | 1 | 2202 |
| 78 | V | V | M | N | S | P | S | N | D | 1 | 2203 |
| 85 | N | D | L | N | D | S | H | V | Q | 1 | 2204 |
| 86 | D | L | N | D | S | H | V | Q | I | 1 | 2205 |
| 100 | H | E | P | L | P | L | A | Y | A | 1 | 2206 |
| 110 | L | Y | L | T | C | V | D | I | S | 1 | 2207 |
| 115 | V | D | I | S | L | D | C | D | L | 1 | 2208 |
| 119 | L | D | C | D | L | N | C | E | G | 1 | 2209 |
| 126 | E | G | R | Q | D | R | N | F | V | 1 | 2210 |
| 132 | N | F | V | D | K | R | Q | W | V | 1 | 2211 |
| 135 | D | K | R | Q | W | V | W | G | P | 1 | 2212 |
| 137 | R | Q | W | V | W | G | P | S | G | 1 | 2213 |
| 147 | G | G | I | L | L | V | N | C | D | 1 | 2214 |
| 149 | I | L | L | V | N | C | D | R | D | 1 | 2215 |
| 150 | L | L | V | N | C | D | R | D | D | 1 | 2216 |
| 151 | L | V | N | C | D | R | D | D | P | 1 | 2217 |
| 152 | V | N | C | D | R | D | D | P | S | 1 | 2218 |
| 158 | D | P | S | C | D | V | Q | D | N | 1 | 2219 |
| 161 | C | D | V | Q | D | N | C | D | Q | 1 | 2220 |
| 164 | Q | D | N | C | D | Q | H | V | H | 1 | 2221 |
| 175 | Q | D | L | E | D | M | S | V | M | 1 | 2222 |
| 182 | V | M | V | L | R | T | Q | G | P | 1 | 2223 |
| 211 | A | Q | V | F | H | I | C | G | P | 1 | 2224 |
| 217 | C | F | P | E | D | V | C | E | A | 1 | 2225 |
| 230 | L | G | Q | D | K | V | S | Y | E | 1 | 2226 |
| 232 | Q | D | K | V | S | Y | E | V | P | 1 | 2227 |
| 233 | D | K | V | S | Y | E | V | P | R | 1 | 2228 |
| 234 | K | V | S | Y | E | V | P | R | L | 1 | 2229 |
| 246 | E | R | F | F | V | E | G | L | | 1 | 2230 |
| 260 | G | F | T | G | L | I | S | F | H | 1 | 2231 |
| 263 | G | L | I | S | F | H | V | T | L | 1 | 2232 |
| 267 | F | H | V | T | L | D | D | D | S | 1 | 2233 |
| 270 | T | L | L | D | D | S | N | E | D | 1 | 2234 |
| 283 | P | I | F | T | D | T | V | V | F | 1 | 2235 |
| 284 | I | F | T | D | T | V | V | F | R | 1 | 2236 |
| 288 | T | V | V | F | R | V | A | P | W | 1 | 2237 |
| 290 | V | F | R | V | A | P | W | I | M | 1 | 2238 |
| 293 | V | A | P | W | I | M | T | P | S | 1 | 2239 |
| 294 | A | P | W | I | M | T | P | S | T | 1 | 2240 |
| 307 | E | V | Y | Y | V | C | R | V | R | N | 1 | 2241 |
| 311 | C | R | V | R | N | N | T | C | F | 1 | 2242 |
| 315 | N | N | T | C | F | V | D | A | V | 1 | 2243 |
| 318 | C | F | V | D | A | V | A | E | L | 1 | 2244 |
| 324 | A | E | L | A | R | K | A | G | C | 1 | 2245 |
| 325 | E | L | A | R | K | A | G | C | K | 1 | 2246 |
| 333 | K | L | T | I | C | P | Q | A | E | 1 | 2247 |
| 337 | C | P | Q | A | E | N | R | N | D | 1 | 2248 |
| 338 | P | Q | A | E | N | R | N | D | R | 1 | 2249 |
| 340 | A | E | N | R | N | D | R | W | I | 1 | 2250 |
| 341 | E | N | R | N | D | R | W | I | Q | 1 | 2251 |
| 360 | P | H | K | T | L | P | V | V | F | 1 | 2252 |
| 366 | V | V | F | D | S | P | R | N | G | 1 | 2253 |
| 371 | P | R | N | G | E | L | Q | D | F | 1 | 2254 |
| 426 | G | R | I | L | I | G | G | N | L | 1 | 2255 |
| 429 | L | I | G | G | N | L | P | G | S | 1 | 2256 |
| 434 | L | P | G | S | S | G | R | R | V | 1 | 2257 |
| 439 | G | R | R | V | T | Q | V | V | R | 1 | 2258 |
| 445 | V | V | R | D | F | L | H | A | Q | 1 | 2259 |
| 448 | D | F | L | H | A | Q | K | V | Q | 1 | 2260 |
| 450 | L | H | A | Q | K | V | Q | P | P | 1 | 2261 |
| 453 | Q | K | V | Q | P | P | V | E | L | 1 | 2262 |
| 456 | Q | P | P | V | E | L | F | V | D | 1 | 2263 |
| 461 | L | F | V | D | W | L | A | V | G | 1 | 2264 |
| 473 | E | F | L | S | F | V | P | A | P | 1 | 2265 |
| 486 | F | R | M | L | L | A | S | P | G | 1 | 2266 |
| 488 | M | L | L | A | S | P | G | A | C | 1 | 2267 |
| 502 | E | K | Q | K | C | G | H | G | R | 1 | 2268 |
| 510 | R | A | L | L | F | Q | G | V | V | 1 | 2269 |
| 516 | G | V | V | D | D | E | Q | V | K | 1 | 2270 |
| 523 | V | K | T | I | S | I | N | Q | V | 1 | 2271 |
| 529 | N | Q | V | L | S | N | K | D | L | 1 | 2272 |
| 537 | L | I | N | Y | N | K | F | V | Q | 1 | 2273 |
| 539 | N | Y | N | K | F | V | Q | S | C | 1 | 2274 |
| 543 | F | V | Q | S | C | I | D | W | N | 1 | 2275 |
| 544 | V | Q | S | C | I | D | W | N | R | 1 | 2276 |
| 557 | R | E | L | G | L | A | E | C | D | 1 | 2277 |
| 558 | E | L | G | L | A | E | C | D | I | 1 | 2278 |
| 562 | A | E | C | D | I | L | D | I | P | 1 | 2279 |
| 573 | F | K | T | E | R | K | K | A | T | 1 | 2280 |
| 589 | N | M | L | V | L | G | K | H | L | 1 | 2281 |
| 595 | K | H | L | G | I | P | K | P | F | 1 | 2282 |
| 604 | G | P | I | I | N | G | C | C | C | 1 | 2283 |
| 610 | C | C | C | L | E | E | K | V | R | 1 | 2284 |
| 622 | E | P | L | G | L | H | C | T | F | 1 | 2285 |
| 623 | P | L | G | L | H | C | T | F | I | 1 | 2286 |
| 642 | G | E | V | H | C | G | T | N | V | 1 | 2287 |
| 645 | H | C | G | T | N | V | C | R | K | 1 | 2288 |

TABLE XXII-continued

| Pos | 1 | 2 | 3 | 4 | 5 | 6 | 7 | 8 | 9 | score | SEQ. ID NO. |
|---|---|---|---|---|---|---|---|---|---|---|---|
| \multicolumn{11}{c}{184P1E2 v.2 HLA Peptide Scoring Results A1 9-mers SYFPEITHI} | | |

184P1E2 v.2 HLA Peptide Scoring Results A1 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 6 | S | T | L | A | P | L | E | V | Y | 25 | 2289 |
| 2 | I | M | T | P | S | T | L | A | P | 10 | 2290 |
| 5 | P | S | T | L | A | P | L | E | V | 10 | 2291 |
| 3 | M | T | P | S | T | L | A | P | L | 6 | 2292 |
| 7 | T | L | A | P | L | E | V | Y | V | 5 | 2293 |
| 1 | W | I | M | T | P | S | T | L | A | 3 | 2294 |
| 9 | A | P | L | E | V | Y | V | C | R | 3 | 2295 |
| 4 | T | P | S | T | L | A | P | L | E | 2 | 2296 |
| 8 | L | A | P | L | E | V | Y | V | C | 2 | 2297 |

184P1E2 v.3 HLA Peptide Scoring Results A1 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | V | P | D | G | K | G | F | R | M | 13 | 2298 |
| 5 | S | F | V | P | V | P | D | G | K | 8 | 2299 |
| 4 | L | S | F | V | P | V | P | D | G | 6 | 2300 |
| 7 | V | P | V | P | D | G | K | G | F | 6 | 2301 |
| 3 | F | L | S | F | V | P | V | P | D | 4 | 2302 |
| 6 | F | V | P | V | P | D | G | K | G | 4 | 2303 |
| 1 | D | E | F | L | S | F | V | P | V | 3 | 2304 |
| 2 | E | F | L | S | F | V | P | V | P | 2 | 2305 |
| 8 | P | V | P | D | G | K | G | F | R | 2 | 2306 |

TABLE XXIII

| Pos | 1 | 2 | 3 | 4 | 5 | 6 | 7 | 8 | 9 | score | SEQ. ID NO. |
|---|---|---|---|---|---|---|---|---|---|---|---|

184P1E2 v.1: HLA Peptide Scoring Results A0201 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 263 | G | L | I | S | F | H | V | T | L | 28 | 2307 |
| 612 | C | L | E | E | K | V | R | S | L | 28 | 2308 |
| 10 | S | L | E | H | P | T | S | A | V | 25 | 2309 |
| 302 | T | L | P | P | L | E | V | Y | V | 25 | 2310 |
| 384 | I | L | G | P | D | F | G | Y | V | 24 | 2311 |
| 25 | T | L | V | D | I | Y | G | S | V | 23 | 2312 |
| 104 | P | L | A | Y | A | V | L | Y | L | 23 | 2313 |
| 111 | Y | L | T | C | V | D | I | S | L | 23 | 2314 |
| 192 | A | L | F | D | D | H | K | L | V | 23 | 2315 |
| 264 | L | I | S | F | H | V | T | L | L | 23 | 2316 |
| 79 | V | M | N | S | P | S | N | D | L | 22 | 2317 |
| 109 | V | L | Y | L | T | C | V | D | I | 22 | 2318 |
| 144 | S | G | Y | G | G | I | L | L | V | 22 | 2319 |
| 86 | D | L | N | D | S | H | V | Q | I | 21 | 2320 |
| 107 | Y | A | V | L | Y | L | T | C | V | 21 | 2321 |
| 176 | D | L | E | D | M | S | V | M | V | 21 | 2322 |
| 305 | P | L | E | V | Y | V | C | R | V | 21 | 2323 |
| 470 | H | V | D | E | F | L | S | F | V | 21 | 2324 |
| 512 | L | L | F | Q | G | V | D | D | V | 21 | 2325 |
| 536 | D | L | I | N | Y | N | K | F | V | 21 | 2326 |
| 591 | L | V | L | G | K | H | L | G | I | 21 | 2327 |
| 619 | S | L | L | E | P | L | G | L | H | 21 | 2328 |
| 72 | A | T | L | E | I | I | V | V | M | 20 | 2329 |
| 191 | A | L | F | D | D | H | K | L | V | 20 | 2330 |
| 409 | N | L | E | V | S | P | P | V | V | 20 | 2331 |
| 417 | V | A | N | G | K | E | Y | P | L | 20 | 2332 |
| 460 | E | L | F | V | D | W | L | A | V | 20 | 2333 |
| 589 | N | M | L | V | L | G | K | H | L | 20 | 2334 |
| 616 | K | V | R | S | L | L | E | P | L | 20 | 2335 |
| 15 | T | S | A | V | C | V | A | G | V | 19 | 2336 |
| 18 | V | C | V | A | G | V | E | T | L | 19 | 2337 |
| 102 | P | L | P | L | A | Y | A | V | L | 19 | 2338 |
| 234 | K | V | S | Y | E | V | P | R | L | 19 | 2339 |
| 285 | F | T | D | T | V | V | F | R | V | 19 | 2340 |
| 298 | M | T | P | S | T | L | P | P | L | 19 | 2341 |
| 318 | C | F | V | D | A | V | A | E | L | 19 | 2342 |
| 428 | I | L | I | G | G | N | L | P | G | 19 | 2343 |
| 605 | P | I | I | N | G | C | C | C | L | 19 | 2344 |
| 1 | M | S | L | Q | R | I | V | R | V | 18 | 2345 |
| 19 | C | V | A | G | V | E | T | L | V | 18 | 2346 |

TABLE XXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 21 | A | G | V | E | T | L | V | D | I | 18 | 2347 |
| 326 | L | A | R | K | A | G | C | K | L | 18 | 2348 |
| 356 | Y | V | Q | A | P | H | K | T | L | 18 | 2349 |
| 358 | Q | A | P | H | K | T | L | P | V | 18 | 2350 |
| 429 | L | I | G | G | N | L | P | G | S | 18 | 2351 |
| 547 | C | I | D | W | N | R | E | V | L | 18 | 2352 |
| 554 | V | L | K | R | E | L | G | L | A | 18 | 2353 |
| 580 | A | T | A | F | F | P | D | L | V | 18 | 2354 |
| 583 | F | F | P | D | L | V | N | M | L | 18 | 2355 |
| 598 | G | I | P | K | P | F | G | P | I | 18 | 2356 |
| 28 | D | I | Y | G | S | V | P | E | G | 17 | 2357 |
| 118 | S | L | D | C | D | L | N | C | E | 17 | 2358 |
| 184 | V | L | R | T | Q | G | P | A | A | 17 | 2359 |
| 281 | A | S | P | I | F | T | D | T | V | 17 | 2360 |
| 322 | A | V | A | E | L | A | R | K | A | 17 | 2361 |
| 359 | A | P | H | K | T | L | P | V | V | 17 | 2362 |
| 489 | L | L | A | S | P | G | A | C | F | 17 | 2363 |
| 510 | R | A | L | L | F | Q | G | V | V | 17 | 2364 |
| 524 | K | T | I | S | I | N | Q | V | L | 17 | 2365 |
| 546 | S | C | I | D | W | N | R | E | V | 17 | 2366 |
| 561 | L | A | E | C | D | I | I | D | I | 17 | 2367 |
| 564 | C | D | I | I | D | I | P | Q | L | 17 | 2368 |
| 639 | M | L | H | G | E | V | H | C | G | 17 | 2369 |
| 2 | S | L | Q | R | I | V | R | V | S | 16 | 2370 |
| 3 | L | Q | R | I | V | R | V | S | L | 16 | 2371 |
| 40 | F | E | V | Y | G | T | T | P | G | V | 16 | 2372 |
| 66 | R | R | W | R | F | D | A | T | L | 16 | 2373 |
| 71 | D | A | T | L | E | I | I | V | V | 16 | 2374 |
| 105 | L | A | Y | A | V | L | Y | L | T | 16 | 2375 |
| 177 | L | E | D | M | S | V | M | V | L | 16 | 2376 |
| 179 | D | M | S | V | M | V | L | R | T | 16 | 2377 |
| 185 | L | R | T | Q | G | P | A | A | L | 16 | 2378 |
| 200 | V | L | H | T | S | S | Y | D | A | 16 | 2379 |
| 270 | T | L | L | D | D | S | N | E | D | 16 | 2380 |
| 312 | R | V | R | N | N | T | C | F | V | 16 | 2381 |
| 404 | L | D | S | F | G | N | L | E | V | 16 | 2382 |
| 408 | G | N | L | E | V | S | P | P | V | 16 | 2383 |
| 437 | S | S | G | S | R | R | V | T | Q | 16 | 2384 |
| 463 | V | D | W | L | A | V | G | H | V | 16 | 2385 |
| 465 | W | L | A | V | G | H | V | D | E | 16 | 2386 |
| 467 | A | V | G | H | V | D | E | F | L | 16 | 2387 |
| 487 | R | M | L | L | A | S | P | G | A | 16 | 2388 |
| 491 | A | S | P | G | A | C | F | K | L | 16 | 2389 |
| 518 | V | D | D | E | Q | V | K | T | I | 16 | 2390 |
| 567 | I | D | I | P | Q | L | F | K | T | 16 | 2391 |
| 579 | K | A | T | A | F | F | P | D | L | 16 | 2392 |
| 44 | G | T | P | G | V | D | I | Y | I | 15 | 2393 |
| 68 | W | R | F | D | A | T | L | E | I | 15 | 2394 |
| 73 | T | L | E | I | I | V | V | M | N | 15 | 2395 |
| 166 | N | C | D | Q | H | V | H | C | L | 15 | 2396 |
| 198 | K | L | V | L | H | T | S | S | Y | 15 | 2397 |
| 205 | S | Y | D | A | K | R | A | Q | V | 15 | 2398 |
| 214 | F | H | I | C | G | P | E | D | V | 15 | 2399 |
| 221 | D | V | C | E | A | Y | R | H | V | 15 | 2400 |
| 229 | V | L | G | Q | D | K | V | S | Y | 15 | 2401 |
| 261 | F | T | G | L | I | S | F | H | V | 15 | 2402 |
| 289 | V | V | F | R | V | A | P | W | I | 15 | 2403 |
| 301 | S | T | L | P | P | L | E | V | Y | 15 | 2404 |
| 315 | N | N | T | C | F | V | D | A | V | 15 | 2405 |
| 328 | R | K | A | G | C | K | L | T | I | 15 | 2406 |
| 368 | F | D | S | P | R | N | G | E | L | 15 | 2407 |
| 402 | S | G | L | D | S | E | G | N | L | 15 | 2408 |
| 421 | K | E | Y | P | L | G | I | L | L | 15 | 2409 |
| 442 | V | T | Q | V | V | R | D | F | L | 15 | 2410 |
| 451 | H | A | Q | K | V | Q | P | P | V | 15 | 2411 |
| 453 | Q | K | V | Q | P | P | V | E | L | 15 | 2412 |
| 458 | P | V | E | L | F | V | D | W | L | 15 | 2413 |
| 505 | K | C | G | H | G | R | A | L | L | 15 | 2414 |
| 509 | G | R | A | L | L | F | Q | G | V | 15 | 2415 |
| 511 | A | L | L | F | Q | G | V | V | D | 15 | 2416 |
| 523 | V | K | T | I | S | I | N | Q | V | 15 | 2417 |
| 527 | S | I | N | Q | V | L | S | N | K | 15 | 2418 |
| 553 | E | V | L | K | R | E | L | G | L | 15 | 2419 |
| 558 | E | L | G | L | A | E | C | D | I | 15 | 2420 |
| 560 | G | L | A | E | C | D | I | I | D | 15 | 2421 |
| 582 | A | F | F | P | D | L | V | N | M | 15 | 2422 |

TABLE XXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 586 | D | L | V | N | M | L | V | L | G | 15 | 2423 |
| 592 | V | L | G | K | H | L | G | I | P | 15 | 2424 |
| 620 | L | L | E | P | L | G | L | H | C | 15 | 2425 |
| 623 | P | L | G | L | H | C | T | F | I | 15 | 2426 |
| 17 | A | V | C | V | A | G | V | E | T | 14 | 2427 |
| 70 | F | D | A | T | L | E | I | I | V | 14 | 2428 |
| 98 | S | S | H | E | P | L | P | L | A | 14 | 2429 |
| 101 | E | P | L | P | L | A | Y | A | V | 14 | 2430 |
| 115 | V | D | I | S | L | D | C | D | L | 14 | 2431 |
| 142 | G | P | S | G | Y | G | G | I | L | 14 | 2432 |
| 149 | I | L | L | V | N | C | D | R | D | 14 | 2433 |
| 169 | Q | H | V | H | C | L | Q | D | L | 14 | 2434 |
| 174 | L | Q | D | L | E | D | M | S | V | 14 | 2435 |
| 193 | L | F | D | D | H | K | L | V | L | 14 | 2436 |
| 208 | A | K | R | A | Q | V | F | H | I | 14 | 2437 |
| 227 | R | H | V | L | G | Q | D | K | V | 14 | 2438 |
| 231 | G | Q | D | K | V | S | Y | E | V | 14 | 2439 |
| 253 | G | L | S | F | P | D | A | G | F | 14 | 2440 |
| 256 | F | P | D | A | G | F | T | G | L | 14 | 2441 |
| 292 | R | V | A | P | W | I | M | T | P | 14 | 2442 |
| 297 | I | M | T | P | S | T | L | P | P | 14 | 2443 |
| 346 | R | W | I | Q | D | E | M | E | L | 14 | 2444 |
| 377 | Q | D | F | P | Y | K | R | I | L | 14 | 2445 |
| 383 | R | I | L | G | P | D | F | G | Y | 14 | 2446 |
| 438 | S | G | R | R | V | T | Q | V | V | 14 | 2447 |
| 455 | V | Q | P | P | V | E | L | F | V | 14 | 2448 |
| 466 | L | A | V | G | H | V | D | E | F | 14 | 2449 |
| 498 | K | L | F | Q | E | K | Q | K | C | 14 | 2450 |
| 517 | V | V | D | D | E | Q | V | K | T | 14 | 2451 |
| 530 | Q | V | L | S | N | K | D | L | I | 14 | 2452 |
| 587 | L | V | N | M | L | V | L | G | K | 14 | 2453 |
| 609 | G | C | C | C | L | E | E | K | V | 14 | 2454 |
| 618 | R | S | L | L | E | P | L | G | L | 14 | 2455 |
| 630 | F | I | D | D | F | T | P | Y | H | 14 | 2456 |
| 638 | H | M | L | H | G | E | V | H | C | 14 | 2457 |
| 55 | N | M | E | R | G | R | E | R | A | 13 | 2458 |
| 271 | L | L | D | D | S | N | E | D | F | 13 | 2459 |
| 282 | S | P | I | F | T | D | T | V | V | 13 | 2460 |
| 334 | L | T | I | C | P | Q | A | E | N | 13 | 2461 |
| 349 | Q | D | E | M | E | L | G | Y | V | 13 | 2462 |
| 362 | K | T | L | P | V | V | F | D | S | 13 | 2463 |
| 393 | T | R | E | P | R | D | R | S | V | 13 | 2464 |
| 403 | G | L | D | S | F | G | N | L | E | 13 | 2465 |
| 426 | G | R | I | L | I | G | G | N | L | 13 | 2466 |
| 427 | R | I | L | I | G | G | N | L | P | 13 | 2467 |
| 445 | V | V | R | D | F | L | H | A | Q | 13 | 2468 |
| 447 | R | D | F | L | H | A | Q | K | V | 13 | 2469 |
| 449 | F | L | H | A | Q | K | V | Q | P | 13 | 2470 |
| 488 | M | L | L | A | S | P | G | A | C | 13 | 2471 |
| 504 | Q | K | C | G | H | G | R | A | L | 13 | 2472 |
| 531 | V | L | S | N | K | D | L | I | N | 13 | 2473 |
| 571 | Q | L | F | K | T | E | R | K | K | 13 | 2474 |
| 574 | K | T | E | R | K | K | A | T | A | 13 | 2475 |
| 590 | M | L | V | L | G | K | H | L | G | 13 | 2476 |
| 599 | I | P | K | P | F | G | P | I | I | 13 | 2477 |
| 606 | I | I | N | G | C | C | C | L | E | 13 | 2478 |
| 621 | L | E | P | L | G | L | H | C | T | 13 | 2479 |
| 655 | F | S | F | K | W | W | N | M | V | 13 | 2480 |
| 32 | S | V | P | E | G | T | E | M | F | 12 | 2481 |
| 42 | V | Y | G | T | P | G | V | D | I | 12 | 2482 |
| 51 | Y | I | S | P | N | M | E | R | G | 12 | 2483 |
| 69 | R | F | D | A | T | L | E | I | I | 12 | 2484 |
| 84 | S | N | D | L | N | D | S | H | V | 12 | 2485 |
| 95 | S | Y | H | S | S | H | E | P | L | 12 | 2486 |
| 132 | N | F | V | D | K | R | Q | W | V | 12 | 2487 |
| 150 | L | L | V | N | C | D | R | D | D | 12 | 2488 |
| 173 | C | L | Q | D | L | E | D | M | S | 12 | 2489 |
| 182 | V | M | V | L | R | T | Q | G | P | 12 | 2490 |
| 217 | C | G | P | E | D | V | C | E | A | 12 | 2491 |
| 222 | V | C | E | A | Y | R | H | V | L | 12 | 2492 |
| 241 | R | L | H | G | D | E | E | R | F | 12 | 2493 |
| 243 | H | G | D | E | E | R | F | V | L | 12 | 2494 |
| 246 | E | E | R | F | V | F | E | G | L | 12 | 2495 |
| 257 | P | D | A | G | F | T | G | L | I | 12 | 2496 |
| 280 | S | A | S | P | I | F | T | D | T | 12 | 2497 |
| 294 | A | P | W | I | M | T | P | S | T | 12 | 2498 |
| 351 | E | M | E | L | G | Y | V | Q | A | 12 | 2499 |
| 363 | T | L | P | V | V | F | D | S | P | 12 | 2500 |
| 375 | E | L | Q | D | F | P | Y | K | R | 12 | 2501 |
| 396 | P | R | D | R | S | V | S | G | L | 12 | 2502 |
| 420 | G | K | E | Y | P | L | G | R | I | 12 | 2503 |
| 424 | P | L | G | R | I | L | I | G | G | 12 | 2504 |
| 433 | N | L | P | G | S | S | G | R | R | 12 | 2505 |
| 434 | L | P | G | S | S | G | R | R | V | 12 | 2506 |
| 454 | K | V | Q | P | P | V | E | L | F | 12 | 2507 |
| 474 | F | L | S | F | V | P | A | P | D | 12 | 2508 |
| 520 | D | E | Q | V | K | T | I | S | I | 12 | 2509 |
| 551 | N | R | E | V | L | K | R | E | L | 12 | 2510 |
| 559 | L | G | L | A | E | C | D | I | I | 12 | 2511 |
| 566 | I | I | D | I | P | Q | L | F | K | 12 | 2512 |
| 596 | H | L | G | I | P | K | P | F | G | 12 | 2513 |
| 632 | D | D | F | T | P | Y | H | M | L | 12 | 2514 |
| 5 | R | I | V | R | V | S | L | E | H | 11 | 2515 |
| 9 | V | S | L | E | H | P | T | S | A | 11 | 2516 |
| 97 | H | S | S | H | E | P | L | P | L | 11 | 2517 |
| 100 | H | E | P | L | P | L | A | Y | A | 11 | 2518 |
| 141 | W | G | P | S | G | Y | G | G | I | 11 | 2519 |
| 148 | G | I | L | L | V | N | C | D | R | 11 | 2520 |
| 155 | D | R | D | D | P | S | C | D | V | 11 | 2521 |
| 163 | V | Q | D | N | C | D | Q | H | V | 11 | 2522 |
| 215 | H | I | C | G | P | E | D | V | C | 11 | 2523 |
| 259 | A | G | F | T | G | L | I | S | F | 11 | 2524 |
| 295 | P | W | I | M | T | P | S | T | L | 11 | 2525 |
| 309 | Y | V | C | R | V | R | N | N | T | 11 | 2526 |
| 333 | K | L | T | I | C | P | Q | A | E | 11 | 2527 |
| 340 | A | E | N | R | N | D | R | W | I | 11 | 2528 |
| 411 | E | V | S | P | P | V | V | A | N | 11 | 2529 |
| 423 | Y | P | L | G | R | I | L | I | G | 11 | 2530 |
| 482 | D | G | K | C | F | R | M | L | L | 11 | 2531 |
| 526 | I | S | I | N | Q | V | L | S | N | 11 | 2532 |
| 584 | F | P | D | L | V | N | M | L | V | 11 | 2533 |
| 613 | L | E | E | K | V | R | S | L | L | 11 | 2534 |
| 625 | G | L | H | C | T | F | I | D | D | 11 | 2535 |
| 642 | G | E | V | H | C | G | T | N | V | 11 | 2536 |
| 6 | I | V | R | V | S | L | E | H | P | 10 | 2537 |
| 37 | T | E | M | F | E | V | Y | G | T | 10 | 2538 |
| 38 | E | M | F | E | V | Y | G | T | P | 10 | 2539 |
| 47 | G | V | D | I | Y | I | S | P | N | 10 | 2540 |
| 75 | E | I | I | V | V | M | N | S | P | 10 | 2541 |
| 76 | I | I | V | V | M | N | S | P | S | 10 | 2542 |
| 108 | A | V | L | Y | L | T | C | V | D | 10 | 2543 |
| 112 | L | T | C | V | D | I | S | L | D | 10 | 2544 |
| 122 | D | L | N | C | E | G | R | Q | D | 10 | 2545 |
| 172 | H | C | L | Q | D | L | E | D | M | 10 | 2546 |
| 183 | M | V | L | R | T | Q | G | P | A | 10 | 2547 |
| 237 | Y | E | V | P | R | L | H | G | D | 10 | 2548 |
| 279 | F | S | A | S | P | I | F | T | D | 10 | 2549 |
| 283 | P | I | F | T | D | T | V | V | F | 10 | 2550 |
| 296 | W | I | M | T | P | S | T | L | P | 10 | 2551 |
| 300 | P | S | T | L | P | P | L | E | V | 10 | 2552 |
| 325 | E | L | A | R | K | L | E | C | K | 10 | 2553 |
| 329 | K | A | G | C | K | L | T | I | C | 10 | 2554 |
| 335 | T | I | C | P | Q | A | E | N | R | 10 | 2555 |
| 352 | M | E | L | G | Y | V | Q | A | P | 10 | 2556 |
| 485 | G | F | R | M | L | L | A | S | P | 10 | 2557 |
| 490 | L | A | S | P | G | A | C | F | K | 10 | 2558 |
| 515 | Q | G | V | V | D | D | E | Q | V | 10 | 2559 |
| 525 | T | I | S | I | N | Q | V | L | S | 10 | 2560 |
| 537 | L | I | N | Y | N | K | F | V | Q | 10 | 2561 |
| 556 | K | R | E | L | G | L | A | E | C | 10 | 2562 |
| 565 | D | I | I | D | I | P | Q | L | F | 10 | 2563 |
| 585 | P | D | L | V | N | M | L | V | L | 10 | 2564 |
| 594 | G | K | H | L | G | I | P | K | P | 10 | 2565 |
| 636 | P | Y | H | M | L | H | G | E | V | 10 | 2566 |
| 12 | E | H | P | T | S | A | V | C | V | 9 | 2567 |
| 22 | G | V | E | T | L | V | D | I | Y | 9 | 2568 |
| 24 | E | T | L | V | D | I | Y | G | S | 9 | 2569 |
| 31 | G | S | V | P | E | G | T | E | M | 9 | 2570 |
| 34 | P | E | G | T | E | M | F | E | V | 9 | 2571 |
| 43 | Y | G | T | P | G | V | D | I | Y | 9 | 2572 |
| 49 | D | I | Y | I | S | P | N | M | E | 9 | 2573 |
| 77 | I | V | V | M | N | S | P | S | N | 9 | 2574 |

TABLE XXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 146 | Y | G | G | I | L | L | V | N | C | 9 | 2575 |
| 147 | G | G | I | L | L | V | N | C | D | 9 | 2576 |
| 186 | R | T | Q | G | P | A | A | L | F | 9 | 2577 |
| 195 | D | D | H | K | L | V | L | H | T | 9 | 2578 |
| 202 | H | T | S | S | Y | D | A | K | R | 9 | 2579 |
| 249 | F | F | V | E | G | L | S | F | P | 9 | 2580 |
| 254 | L | S | F | P | D | A | G | F | T | 9 | 2581 |
| 288 | T | V | V | F | R | V | A | P | W | 9 | 2582 |
| 316 | N | T | C | F | V | D | A | V | A | 9 | 2583 |
| 319 | F | V | D | A | V | A | E | L | A | 9 | 2584 |
| 321 | D | A | V | A | E | L | A | R | K | 9 | 2585 |
| 347 | W | I | Q | D | E | M | E | L | G | 9 | 2586 |
| 376 | L | Q | D | F | P | Y | K | R | I | 9 | 2587 |
| 385 | L | G | P | D | F | G | Y | V | T | 9 | 2588 |
| 400 | S | V | S | G | L | D | S | F | G | 9 | 2589 |
| 410 | L | E | V | S | P | P | V | V | A | 9 | 2590 |
| 412 | V | S | P | P | V | V | A | N | G | 9 | 2591 |
| 416 | V | V | A | N | G | K | E | Y | P | 9 | 2592 |
| 444 | Q | V | V | R | D | F | L | H | A | 9 | 2593 |
| 450 | L | H | A | Q | K | V | Q | P | P | 9 | 2594 |
| 461 | L | F | V | D | W | L | A | V | G | 9 | 2595 |
| 462 | F | V | D | W | L | A | V | G | H | 9 | 2596 |
| 480 | A | P | D | G | K | G | F | R | M | 9 | 2597 |
| 481 | P | D | G | K | G | F | R | M | L | 9 | 2598 |
| 494 | G | A | C | F | K | L | F | Q | E | 9 | 2599 |
| 529 | N | Q | V | L | S | N | K | D | L | 9 | 2600 |
| 543 | F | V | Q | S | C | I | D | W | N | 9 | 2601 |
| 568 | D | I | P | Q | L | F | K | T | E | 9 | 2602 |
| 601 | K | P | F | G | P | I | I | N | G | 9 | 2603 |
| 640 | L | H | G | E | V | H | C | G | T | 9 | 2604 |
| 20 | V | A | G | V | E | T | L | V | D | 8 | 2605 |
| 74 | L | E | I | I | V | V | M | N | S | 8 | 2606 |
| 106 | A | Y | A | V | L | Y | L | T | C | 8 | 2607 |
| 110 | L | Y | L | T | C | V | D | I | S | 8 | 2608 |
| 114 | C | V | D | I | S | L | D | C | D | 8 | 2609 |
| 126 | E | G | R | Q | D | R | N | F | V | 8 | 2610 |
| 139 | W | V | W | G | P | S | G | Y | G | 8 | 2611 |
| 143 | P | S | G | Y | G | G | I | L | L | 8 | 2612 |
| 145 | G | Y | G | G | I | L | L | V | N | 8 | 2613 |
| 175 | Q | D | L | E | D | M | S | V | M | 8 | 2614 |
| 181 | S | V | M | V | L | R | T | Q | G | 8 | 2615 |
| 194 | F | D | D | H | K | L | V | L | H | 8 | 2616 |
| 199 | L | V | L | H | T | S | S | Y | D | 8 | 2617 |
| 224 | E | A | Y | R | H | V | L | G | Q | 8 | 2618 |
| 230 | L | G | Q | D | K | V | S | Y | E | 8 | 2619 |
| 284 | I | F | T | D | T | V | V | F | R | 8 | 2620 |
| 353 | E | L | G | D | Y | V | Q | A | P | H | 8 | 2621 |
| 355 | G | Y | V | Q | A | P | H | K | T | 8 | 2622 |
| 379 | F | P | Y | K | R | I | L | G | P | 8 | 2623 |
| 392 | V | T | R | E | P | R | D | R | S | 8 | 2624 |
| 399 | R | S | V | S | G | L | D | S | F | 8 | 2625 |
| 425 | L | G | R | I | L | I | G | G | N | 8 | 2626 |
| 432 | G | N | L | P | G | S | S | G | R | 8 | 2627 |
| 477 | F | V | P | A | P | D | G | K | G | 8 | 2628 |
| 484 | K | G | F | R | M | L | L | A | S | 8 | 2629 |
| 513 | L | F | Q | G | V | V | D | D | E | 8 | 2630 |
| 533 | S | N | K | D | L | I | N | Y | N | 8 | 2631 |
| 539 | N | Y | N | K | F | V | Q | S | C | 8 | 2632 |
| 540 | Y | N | K | F | V | Q | S | C | I | 8 | 2633 |
| 588 | V | N | M | L | V | L | G | K | H | 8 | 2634 |
| 597 | L | G | I | P | K | P | F | G | P | 8 | 2635 |
| 7 | V | R | V | S | L | E | H | P | T | 7 | 2636 |
| 8 | R | V | S | L | E | H | P | T | S | 7 | 2637 |
| 13 | H | P | T | S | A | V | C | V | A | 7 | 2638 |
| 26 | L | V | D | I | Y | G | S | V | P | 7 | 2639 |
| 29 | I | Y | G | S | V | P | E | G | T | 7 | 2640 |
| 36 | G | T | E | M | F | E | V | Y | G | 7 | 2641 |
| 48 | V | D | I | Y | I | S | P | N | M | 7 | 2642 |
| 50 | I | Y | I | S | P | N | M | E | R | 7 | 2643 |
| 64 | D | T | R | R | W | R | F | D | A | 7 | 2644 |
| 82 | S | P | S | N | D | L | N | D | S | 7 | 2645 |
| 91 | H | V | Q | I | S | Y | H | S | S | 7 | 2646 |
| 93 | Q | I | S | Y | H | S | S | H | E | 7 | 2647 |
| 103 | L | P | L | A | Y | A | V | L | Y | 7 | 2648 |
| 116 | D | I | S | L | D | C | D | L | N | 7 | 2649 |
| 129 | Q | D | R | N | F | V | D | K | R | 7 | 2650 |
| 151 | L | V | N | C | D | R | D | D | P | 7 | 2651 |
| 228 | H | V | L | G | Q | D | K | V | S | 7 | 2652 |
| 250 | F | V | E | G | L | S | F | P | D | 7 | 2653 |
| 260 | G | F | T | G | L | I | S | F | H | 7 | 2654 |
| 262 | T | G | L | I | S | F | H | V | T | 7 | 2655 |
| 266 | S | F | H | V | T | L | L | D | D | 7 | 2656 |
| 269 | V | T | L | L | D | D | S | N | E | 7 | 2657 |
| 275 | S | N | E | D | F | S | A | S | P | 7 | 2658 |
| 276 | N | E | D | F | S | A | S | P | I | 7 | 2659 |
| 287 | D | T | V | V | F | R | V | A | P | 7 | 2660 |
| 303 | L | P | P | L | E | V | Y | V | C | 7 | 2661 |
| 314 | R | N | N | T | C | F | V | D | A | 7 | 2662 |
| 324 | A | E | L | A | R | K | A | G | C | 7 | 2663 |
| 332 | C | K | L | T | I | C | P | Q | A | 7 | 2664 |
| 366 | V | V | F | D | S | P | R | N | G | 7 | 2665 |
| 406 | S | F | G | N | L | E | V | S | P | 7 | 2666 |
| 422 | E | Y | P | L | G | R | I | L | I | 7 | 2667 |
| 436 | G | S | S | G | R | V | V | T | Q | 7 | 2668 |
| 441 | R | V | T | Q | V | V | R | D | F | 7 | 2669 |
| 532 | L | S | N | K | D | L | I | N | Y | 7 | 2670 |
| 549 | D | W | N | R | E | V | L | K | R | 7 | 2671 |
| 555 | L | K | R | E | L | G | L | A | E | 7 | 2672 |
| 562 | A | E | C | D | I | I | D | I | P | 7 | 2673 |
| 626 | L | H | C | T | F | I | D | D | F | 7 | 2674 |
| 628 | C | T | F | I | D | D | F | T | P | 7 | 2675 |
| 635 | T | P | Y | H | M | L | H | G | E | 7 | 2676 |
| 649 | N | V | C | R | K | F | S | F | | 7 | 2677 |
| 4 | Q | R | I | V | R | V | S | L | E | 6 | 2678 |
| 11 | L | E | H | P | T | S | A | V | C | 6 | 2679 |
| 16 | S | A | V | C | V | A | G | V | E | 6 | 2680 |
| 27 | V | D | I | Y | G | S | V | P | E | 6 | 2681 |
| 78 | V | V | M | N | S | P | S | N | D | 6 | 2682 |
| 87 | L | N | D | S | H | V | Q | I | S | 6 | 2683 |
| 92 | V | Q | I | S | Y | H | S | S | H | 6 | 2684 |
| 94 | I | S | Y | H | S | S | H | E | P | 6 | 2685 |
| 99 | S | H | E | P | L | P | L | A | Y | 6 | 2686 |
| 117 | I | S | L | D | C | D | L | N | C | 6 | 2687 |
| 119 | L | D | C | D | L | N | C | E | G | 6 | 2688 |
| 123 | L | N | C | E | G | R | Q | D | R | 6 | 2689 |
| 180 | M | S | V | M | V | L | R | T | Q | 6 | 2690 |
| 211 | A | Q | V | F | H | I | C | G | P | 6 | 2691 |
| 216 | I | C | G | P | E | D | V | C | E | 6 | 2692 |
| 225 | A | Y | R | H | V | L | G | Q | D | 6 | 2693 |
| 251 | V | E | G | L | S | F | P | D | A | 6 | 2694 |
| 265 | I | S | F | H | V | T | L | L | D | 6 | 2695 |
| 267 | F | H | V | T | L | L | D | D | S | 6 | 2696 |
| 268 | H | V | T | L | L | D | D | S | N | 6 | 2697 |
| 291 | F | R | V | A | P | W | I | M | T | 6 | 2698 |
| 327 | A | R | K | A | G | C | K | L | T | 6 | 2699 |
| 344 | N | D | R | W | I | Q | D | E | M | 6 | 2700 |
| 348 | I | Q | D | E | M | E | L | G | Y | 6 | 2701 |
| 361 | H | K | T | L | P | V | V | F | D | 6 | 2702 |
| 386 | G | P | D | F | G | Y | V | T | R | 6 | 2703 |
| 405 | D | S | F | G | N | L | E | V | S | 6 | 2704 |
| 407 | F | G | N | L | E | V | S | P | P | 6 | 2705 |
| 440 | R | R | V | T | Q | V | V | R | D | 6 | 2706 |
| 459 | V | E | L | F | V | D | W | L | A | 6 | 2707 |
| 472 | D | E | F | L | S | F | V | P | A | 6 | 2708 |
| 473 | E | F | L | S | F | V | P | A | P | 6 | 2709 |
| 495 | A | C | F | K | L | F | Q | E | K | 6 | 2710 |
| 503 | K | Q | K | C | G | H | G | R | A | 6 | 2711 |
| 507 | G | H | G | R | A | L | L | F | Q | 6 | 2712 |
| 516 | G | V | V | D | D | E | Q | V | K | 6 | 2713 |
| 528 | I | N | Q | V | L | S | N | K | D | 6 | 2714 |
| 535 | K | D | L | I | W | Y | N | K | F | 6 | 2715 |
| 538 | I | N | Y | N | K | F | V | Q | S | 6 | 2716 |
| 572 | L | F | K | T | E | R | K | K | A | 6 | 2717 |
| 573 | F | K | T | E | R | K | K | A | T | 6 | 2718 |
| 581 | T | A | F | F | P | D | L | V | N | 6 | 2719 |
| 608 | N | G | C | C | C | L | E | E | K | 6 | 2720 |
| 611 | C | C | L | E | E | K | V | R | S | 6 | 2721 |
| 624 | L | G | L | H | C | T | F | I | D | 6 | 2722 |
| 631 | I | D | D | F | T | P | Y | H | M | 6 | 2723 |
| 643 | E | V | H | C | G | T | N | V | C | 6 | 2724 |
| 30 | Y | G | S | V | P | E | G | T | H | 5 | 2725 |
| 45 | T | P | G | V | D | I | Y | I | S | 5 | 2726 |

TABLE XXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 65 | T | R | R | W | R | F | D | A | T | 5 | 2727 |
| 133 | F | V | D | K | R | Q | W | V | W | 5 | 2728 |
| 140 | V | W | G | P | S | G | Y | G | G | 5 | 2729 |
| 170 | H | V | H | C | L | Q | D | L | E | 5 | 2730 |
| 196 | D | H | K | L | V | L | H | T | S | 5 | 2731 |
| 197 | H | K | L | V | L | H | T | S | S | 5 | 2732 |
| 204 | S | S | Y | D | A | K | R | A | Q | 5 | 2733 |
| 210 | R | A | Q | V | F | H | I | C | G | 5 | 2734 |
| 212 | Q | V | F | H | I | C | G | P | E | 5 | 2735 |
| 255 | S | F | P | D | A | G | F | T | G | 5 | 2736 |
| 273 | D | D | S | N | E | D | F | S | A | 5 | 2737 |
| 290 | V | F | R | V | A | P | W | I | M | 5 | 2738 |
| 293 | V | A | P | W | I | M | T | P | S | 5 | 2739 |
| 308 | V | Y | V | C | R | V | R | N | N | 5 | 2740 |
| 320 | V | D | A | V | A | E | L | A | R | 5 | 2741 |
| 330 | A | G | C | K | L | T | I | C | P | 5 | 2742 |
| 357 | V | Q | A | P | H | K | T | L | P | 5 | 2743 |
| 370 | S | P | R | N | G | E | L | Q | D | 5 | 2744 |
| 382 | K | R | I | L | G | P | D | F | G | 5 | 2745 |
| 387 | P | D | F | G | Y | V | T | R | E | 5 | 2746 |
| 391 | Y | V | T | R | E | P | R | D | R | 5 | 2747 |
| 430 | I | G | G | N | L | P | G | S | S | 5 | 2748 |
| 431 | G | G | N | L | P | G | S | S | G | 5 | 2749 |
| 469 | G | H | V | D | E | F | L | S | F | 5 | 2750 |
| 475 | L | S | F | V | P | A | P | D | G | 5 | 2751 |
| 476 | S | F | V | P | A | P | D | G | K | 5 | 2752 |
| 478 | V | P | A | P | D | G | K | G | F | 5 | 2753 |
| 483 | G | K | G | F | R | M | L | L | A | 5 | 2754 |
| 508 | H | G | R | A | L | L | F | Q | G | 5 | 2755 |
| 548 | I | D | W | N | R | E | V | L | K | 5 | 2756 |
| 550 | W | N | R | E | V | L | K | R | E | 5 | 2757 |
| 557 | R | E | L | G | L | A | E | C | D | 5 | 2758 |
| 569 | I | P | Q | L | F | K | T | E | R | 5 | 2759 |
| 602 | P | F | G | P | I | I | N | G | C | 5 | 2760 |
| 607 | I | N | G | C | C | C | L | E | E | 5 | 2761 |
| 634 | F | T | P | Y | H | M | L | H | G | 5 | 2762 |
| 644 | V | H | C | G | T | N | V | C | R | 5 | 2763 |
| 647 | G | T | N | V | C | R | K | P | F | 5 | 2764 |
| 14 | P | T | S | A | V | C | V | A | G | 4 | 2765 |
| 41 | E | V | Y | G | T | P | G | V | D | 4 | 2766 |
| 58 | R | G | R | E | R | A | D | T | R | 4 | 2767 |
| 62 | R | A | D | T | R | R | W | R | F | 4 | 2768 |
| 135 | D | K | R | Q | W | V | W | G | P | 4 | 2769 |
| 137 | R | Q | W | V | W | G | P | S | G | 4 | 2770 |
| 162 | D | V | Q | D | N | C | D | Q | H | 4 | 2771 |
| 171 | V | H | C | L | Q | D | L | E | D | 4 | 2772 |
| 188 | Q | G | P | A | A | L | F | D | D | 4 | 2773 |
| 189 | G | P | A | A | L | F | D | D | H | 4 | 2774 |
| 190 | P | A | A | L | F | D | D | H | K | 4 | 2775 |
| 206 | Y | D | A | K | R | A | Q | V | F | 4 | 2776 |
| 207 | D | A | K | R | A | Q | V | F | H | 4 | 2777 |
| 209 | K | R | A | Q | V | F | H | I | C | 4 | 2778 |
| 213 | V | F | H | I | C | G | P | E | D | 4 | 2779 |
| 235 | V | S | Y | E | V | P | R | L | H | 4 | 2780 |
| 248 | R | F | F | V | E | G | L | S | F | 4 | 2781 |
| 307 | E | V | Y | V | C | R | V | R | N | 4 | 2782 |
| 310 | V | C | R | V | R | N | N | T | C | 4 | 2783 |
| 317 | T | C | F | V | D | A | V | A | E | 4 | 2784 |
| 323 | V | A | E | L | A | R | K | A | G | 4 | 2785 |
| 331 | G | C | K | L | T | I | C | P | Q | 4 | 2786 |
| 343 | R | N | D | R | W | I | Q | D | E | 4 | 2787 |
| 350 | D | E | M | E | L | G | Y | V | Q | 4 | 2788 |
| 354 | L | G | Y | V | Q | A | P | H | K | 4 | 2789 |
| 367 | V | F | D | S | P | R | N | G | E | 4 | 2790 |
| 371 | P | R | N | G | E | L | Q | D | F | 4 | 2791 |
| 374 | G | E | L | Q | D | F | P | Y | K | 4 | 2792 |
| 381 | Y | K | R | I | L | G | P | D | F | 4 | 2793 |
| 413 | S | P | P | V | V | A | N | G | K | 4 | 2794 |
| 419 | N | G | K | E | Y | P | L | G | R | 4 | 2795 |
| 456 | Q | P | P | V | E | L | F | V | D | 4 | 2796 |
| 479 | P | A | P | D | G | K | G | F | R | 4 | 2797 |
| 499 | L | F | Q | E | V | P | K | C | G | 4 | 2798 |
| 595 | K | H | L | G | I | P | K | P | F | 4 | 2799 |
| 615 | E | K | V | R | S | L | L | E | P | 4 | 2800 |
| 622 | E | P | L | G | L | H | C | T | F | 4 | 2801 |
| 645 | H | C | G | T | N | V | C | R | K | 4 | 2802 |
| 651 | C | R | K | P | F | S | F | K | W | 4 | 2803 |
| 52 | I | S | P | N | M | E | R | G | R | 3 | 2804 |
| 53 | S | P | N | M | E | R | G | R | E | 3 | 2805 |
| 56 | M | E | R | G | R | E | R | A | D | 3 | 2806 |
| 57 | E | R | G | R | E | R | A | D | T | 3 | 2807 |
| 85 | N | D | L | N | D | S | H | V | Q | 3 | 2808 |
| 89 | D | S | H | V | Q | I | S | Y | H | 3 | 2809 |
| 90 | S | H | V | Q | I | S | Y | H | S | 3 | 2810 |
| 96 | Y | H | S | S | H | E | P | L | P | 3 | 2811 |
| 138 | Q | W | V | W | G | P | S | G | Y | 3 | 2812 |
| 153 | N | C | D | R | D | P | P | S | C | 3 | 2813 |
| 158 | D | P | S | C | D | V | Q | D | N | 3 | 2814 |
| 160 | S | C | D | V | Q | D | N | C | D | 3 | 2815 |
| 187 | T | Q | G | P | A | A | L | F | D | 3 | 2816 |
| 223 | C | E | A | Y | R | H | V | L | G | 3 | 2817 |
| 226 | Y | R | H | V | L | G | Q | D | K | 3 | 2818 |
| 236 | S | Y | E | V | P | R | L | H | G | 3 | 2819 |
| 239 | V | P | R | L | H | G | D | E | E | 3 | 2820 |
| 240 | P | R | L | H | G | D | E | E | R | 3 | 2821 |
| 242 | L | H | G | D | E | E | R | F | F | 3 | 2822 |
| 245 | D | E | E | R | F | F | V | E | G | 3 | 2823 |
| 258 | D | A | G | F | T | G | L | I | S | 3 | 2824 |
| 274 | D | S | N | E | D | F | S | A | S | 3 | 2825 |
| 278 | D | F | S | A | S | P | I | F | T | 3 | 2826 |
| 286 | T | D | T | V | V | F | R | V | A | 3 | 2827 |
| 304 | P | P | L | E | V | Y | V | C | R | 3 | 2828 |
| 336 | I | C | P | Q | A | E | N | R | N | 3 | 2829 |
| 339 | Q | A | E | N | R | N | D | R | W | 3 | 2830 |
| 364 | L | P | V | V | F | D | S | P | R | 3 | 2831 |
| 372 | R | N | G | E | L | Q | D | F | P | 3 | 2832 |
| 418 | A | N | G | K | E | Y | P | L | G | 3 | 2833 |
| 435 | P | G | S | S | G | R | R | V | T | 3 | 2834 |
| 439 | G | R | R | V | T | Q | V | V | R | 3 | 2835 |
| 446 | V | R | D | F | L | H | A | Q | K | 3 | 2836 |
| 486 | F | R | M | L | L | A | S | P | G | 3 | 2837 |
| 506 | C | G | H | G | R | A | L | L | F | 3 | 2838 |
| 514 | F | Q | G | V | V | D | D | E | Q | 3 | 2839 |
| 522 | Q | V | K | T | I | S | I | N | Q | 3 | 2840 |
| 578 | K | K | A | T | A | E | F | P | D | 3 | 2841 |
| 604 | G | P | I | I | N | G | C | C | C | 3 | 2842 |
| 617 | V | R | S | L | L | E | P | L | G | 3 | 2843 |
| 629 | T | F | I | D | D | F | T | P | Y | 3 | 2844 |
| 637 | Y | H | M | L | H | G | E | V | H | 3 | 2845 |
| 653 | K | P | F | S | F | K | W | W | N | 3 | 2846 |
| 33 | V | P | E | G | T | E | M | F | E | 2 | 2847 |
| 54 | P | N | M | E | R | G | R | E | R | 2 | 2848 |
| 60 | R | E | R | A | D | T | R | R | W | 2 | 2849 |
| 80 | M | N | S | P | S | N | D | L | N | 2 | 2850 |
| 83 | P | S | N | D | L | N | D | S | H | 2 | 2851 |
| 88 | N | D | S | H | V | Q | I | S | Y | 2 | 2852 |
| 113 | T | C | V | D | I | S | L | D | C | 2 | 2853 |
| 121 | C | D | L | N | C | E | G | R | Q | 2 | 2854 |
| 127 | G | R | Q | D | R | N | F | V | D | 2 | 2855 |
| 128 | R | Q | D | R | N | F | V | D | K | 2 | 2856 |
| 134 | V | D | K | R | Q | W | V | W | G | 2 | 2857 |
| 152 | V | N | C | D | R | D | D | P | S | 2 | 2858 |
| 156 | R | D | D | P | S | C | D | V | Q | 2 | 2859 |
| 164 | Q | D | N | C | D | Q | H | V | H | 2 | 2860 |
| 165 | D | N | C | D | Q | H | V | H | C | 2 | 2861 |
| 201 | L | H | T | S | S | Y | D | A | K | 2 | 2862 |
| 203 | T | S | S | Y | D | A | K | R | A | 2 | 2863 |
| 218 | G | P | E | D | V | C | E | A | Y | 2 | 2864 |
| 233 | D | K | V | S | Y | E | V | P | R | 2 | 2865 |
| 238 | E | V | P | R | L | H | G | D | E | 2 | 2866 |
| 244 | G | D | E | E | R | F | F | V | E | 2 | 2867 |
| 272 | L | D | D | S | N | E | D | F | S | 2 | 2868 |
| 299 | T | P | S | T | L | P | P | L | E | 2 | 2869 |
| 313 | V | R | N | N | T | C | F | V | D | 2 | 2870 |
| 338 | P | Q | A | E | N | R | N | D | R | 2 | 2871 |
| 342 | N | R | N | D | R | W | I | Q | D | 2 | 2872 |
| 388 | D | F | G | Y | V | T | R | E | P | 2 | 2873 |
| 389 | F | G | Y | V | T | R | E | P | R | 2 | 2874 |
| 390 | G | Y | V | T | R | E | P | R | D | 2 | 2875 |
| 395 | E | P | R | D | R | S | V | S | G | 2 | 2876 |
| 401 | V | S | G | L | D | S | F | G | N | 2 | 2877 |
| 415 | P | V | V | A | N | G | K | E | Y | 2 | 2878 |

TABLE XXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 452 | A | Q | K | V | Q | P | P | V | E | 2 | 2879 |
| 457 | P | P | V | E | L | F | V | D | W | 2 | 2880 |
| 464 | D | W | L | A | V | G | H | V | D | 2 | 2881 |
| 496 | C | F | K | L | F | Q | E | K | Q | 2 | 2882 |
| 575 | T | E | R | K | K | A | T | A | F | 2 | 2883 |
| 593 | L | G | K | H | L | G | I | P | K | 2 | 2884 |
| 627 | H | C | T | F | I | D | D | F | T | 2 | 2885 |
| 650 | V | C | R | K | P | F | S | F | K | 2 | 2886 |
| 63 | A | D | T | R | R | W | R | F | D | 1 | 2887 |
| 81 | N | S | P | S | N | D | L | N | D | 1 | 2888 |
| 124 | N | C | E | G | R | Q | D | R | N | 1 | 2889 |
| 131 | R | N | F | V | D | K | R | Q | W | 1 | 2890 |
| 136 | K | R | Q | W | V | W | G | P | S | 1 | 2891 |
| 154 | C | D | R | D | D | P | S | C | D | 1 | 2892 |
| 157 | D | D | P | S | C | D | V | Q | D | 1 | 2893 |
| 252 | E | G | L | S | F | P | D | A | G | 1 | 2894 |
| 306 | L | E | V | Y | V | C | R | V | R | 1 | 2895 |
| 365 | P | V | V | F | D | S | P | R | N | 1 | 2896 |
| 468 | V | G | H | V | D | E | F | L | S | 1 | 2897 |
| 492 | S | P | G | A | C | F | K | L | F | 1 | 2898 |
| 493 | P | G | A | C | F | K | L | F | Q | 1 | 2899 |
| 497 | F | K | L | F | Q | E | K | Q | K | 1 | 2900 |
| 500 | F | Q | E | K | Q | K | C | G | H | 1 | 2901 |
| 521 | E | Q | V | K | T | I | S | I | N | 1 | 2902 |
| 534 | N | K | D | L | I | N | Y | N | K | 1 | 2903 |
| 541 | N | K | F | V | Q | S | C | I | D | 1 | 2904 |
| 542 | K | F | V | Q | S | C | I | D | W | 1 | 2905 |
| 544 | V | Q | S | C | I | D | W | N | R | 1 | 2906 |
| 545 | Q | S | C | I | D | W | N | R | E | 1 | 2907 |
| 552 | R | E | V | L | K | R | E | L | G | 1 | 2908 |
| 570 | P | Q | L | F | K | T | E | R | K | 1 | 2909 |
| 603 | F | G | P | I | I | N | G | C | C | 1 | 2910 |
| 633 | D | F | T | P | Y | H | M | L | H | 1 | 2911 |
| 641 | H | G | E | V | H | C | G | T | N | 1 | 2912 |
| 646 | C | G | T | N | V | C | R | K | P | 1 | 2913 |
| 648 | T | N | V | C | R | K | P | F | S | 1 | 2914 |
| 654 | P | S | F | S | K | W | W | N | M | 1 | 2915 |
| 656 | S | F | K | W | W | N | M | V | P | 1 | 2916 |
| 67 | R | W | R | F | D | A | T | L | E | −1 | 2917 |
| 219 | P | E | D | V | C | E | A | Y | R | −1 | 2918 |
| 232 | Q | D | K | V | S | Y | E | V | P | −1 | 2919 |
| 277 | E | D | F | S | A | S | P | I | F | −1 | 2920 |
| 360 | P | H | K | T | L | P | V | V | F | −1 | 2921 |
| 369 | D | S | P | R | N | G | E | L | Q | −1 | 2922 |
| 373 | N | G | E | L | Q | D | F | P | Y | −1 | 2923 |
| 378 | D | F | P | Y | K | R | I | L | G | −1 | 2924 |
| 414 | P | P | V | V | A | N | G | K | E | −1 | 2925 |
| 502 | E | K | Q | K | C | G | H | G | R | −1 | 2926 |
| 577 | R | K | K | A | T | A | F | F | P | −1 | 2927 |
| 610 | C | C | C | L | E | E | K | V | R | −1 | 2928 |
| 35 | E | G | T | E | M | F | E | V | Y | −2 | 2929 |
| 130 | D | R | N | F | V | D | K | R | Q | −2 | 2930 |
| 159 | P | S | C | D | V | Q | D | N | C | −2 | 2931 |
| 220 | E | D | V | C | E | A | Y | R | H | −2 | 2932 |
| 519 | D | D | E | Q | V | K | T | I | S | −2 | 2933 |
| 600 | P | K | P | F | G | P | I | I | N | −2 | 2934 |
| 652 | R | K | P | F | S | E | K | W | W | −2 | 2935 |
| 247 | E | R | F | F | V | E | G | L | S | −3 | 2936 |
| 341 | E | N | R | N | D | R | W | I | Q | −3 | 2937 |
| 563 | E | C | D | I | I | D | I | P | Q | −3 | 2938 |
| 614 | E | E | K | V | R | S | L | E | L | −3 | 2939 |
| 184P1E2 v.2: HLA Peptide Scoring Results A0201 9-mers SYFPEITHI | | | | | | | | | | | |
| 7 | T | L | A | P | L | E | V | Y | V | 27 | 2940 |
| 3 | M | T | P | S | T | L | A | P | L | 20 | 2941 |
| 2 | I | M | T | P | S | T | L | A | P | 15 | 2942 |
| 1 | W | I | M | T | P | S | T | L | A | 14 | 2943 |
| 6 | S | T | L | A | P | L | E | V | Y | 13 | 2944 |
| 8 | L | A | P | L | E | V | Y | V | C | 11 | 2945 |
| 5 | P | S | T | L | A | P | L | E | V | 9 | 2946 |
| 9 | A | P | L | E | V | Y | V | C | R | 8 | 2947 |
| 4 | T | P | S | T | L | A | P | L | E | 2 | 2948 |

184P1E2 v.3: HLA Peptide Scoring Results A0201 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 1 | D | E | F | L | S | F | V | P | V | 12 | 2949 |
| 3 | F | L | S | F | V | P | V | P | D | 12 | 2950 |
| 4 | L | S | F | V | P | V | P | D | G | 9 | 2951 |
| 6 | F | V | P | V | P | D | G | K | G | 8 | 2952 |
| 9 | V | P | D | G | K | G | F | R | M | 8 | 2953 |
| 2 | E | F | L | S | F | V | P | V | P | 5 | 2954 |
| 5 | S | F | V | P | V | P | D | G | K | 5 | 2955 |
| 8 | P | V | P | D | G | K | G | F | R | 4 | 2956 |
| 7 | V | P | V | P | D | G | K | G | F | 3 | 2957 |

TABLE XXIV

184P1E2: HLA Peptide Scoring Results A0202 9-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XXV

184P1E2: HLA Peptide Scoring Results A0203 9-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XXVI

184P1E2 v.1: HLA Peptide Scoring Results A3 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 325 | E | L | A | R | K | A | G | C | K | 29 | 2958 |
| 511 | A | L | L | F | Q | G | V | V | D | 26 | 2959 |
| 198 | K | L | V | L | H | T | S | S | Y | 25 | 2960 |
| 516 | G | V | V | D | D | E | Q | V | K | 25 | 2961 |
| 566 | I | I | D | I | P | Q | L | F | K | 24 | 2962 |
| 5 | R | I | V | R | V | S | L | E | H | 23 | 2963 |
| 292 | R | V | A | P | W | I | M | T | P | 23 | 2964 |
| 527 | S | I | N | Q | V | L | S | N | K | 23 | 2965 |
| 587 | L | V | N | M | L | V | L | G | K | 23 | 2966 |
| 41 | E | V | Y | G | T | P | G | V | D | 22 | 2967 |
| 229 | V | L | G | Q | D | K | V | S | Y | 22 | 2968 |
| 383 | R | I | L | G | P | D | F | G | Y | 22 | 2969 |
| 428 | I | L | I | G | G | N | L | P | G | 22 | 2970 |
| 571 | Q | L | F | K | T | E | R | K | K | 22 | 2971 |
| 26 | L | V | D | I | Y | G | S | V | P | 21 | 2972 |
| 58 | R | G | R | E | R | A | D | T | R | 21 | 2973 |
| 128 | R | Q | D | R | N | F | V | D | K | 21 | 2974 |
| 263 | G | L | I | S | F | H | V | T | L | 21 | 2975 |
| 415 | P | V | V | A | N | G | K | E | Y | 21 | 2976 |
| 462 | F | V | D | W | L | A | V | G | H | 21 | 2977 |
| 489 | L | L | A | S | P | G | A | C | F | 21 | 2978 |
| 649 | N | V | C | R | K | P | F | S | F | 21 | 2979 |
| 17 | A | V | C | V | A | G | V | E | T | 20 | 2980 |
| 241 | R | L | H | G | D | E | E | R | F | 20 | 2981 |
| 283 | P | I | F | T | D | D | T | V | V | F | 20 | 2982 |
| 427 | R | I | L | I | G | G | N | L | P | 20 | 2983 |
| 454 | K | V | Q | P | P | V | E | L | F | 20 | 2984 |
| 8 | R | V | S | L | E | H | P | T | S | 19 | 2985 |
| 32 | S | V | P | E | G | T | E | M | F | 19 | 2986 |
| 108 | A | V | L | Y | L | T | C | V | D | 19 | 2987 |

TABLE XXVI-continued

| Pos | 1 | 2 | 3 | 4 | 5 | 6 | 7 | 8 | 9 | score | SEQ. ID NO. |
|---|---|---|---|---|---|---|---|---|---|---|---|
| 109 | V | L | Y | L | T | C | V | D | I | 19 | 2988 |
| 307 | E | V | Y | V | C | R | V | R | N | 19 | 2989 |
| 441 | R | V | T | Q | V | V | R | D | F | 19 | 2990 |
| 449 | F | L | H | A | Q | K | V | Q | P | 19 | 2991 |
| 548 | I | D | W | W | R | E | V | L | K | 19 | 2992 |
| 619 | S | L | L | E | P | L | G | L | H | 19 | 2993 |
| 620 | L | L | E | P | L | G | L | H | C | 19 | 2994 |
| 2 | S | L | Q | R | I | V | R | V | S | 18 | 2995 |
| 86 | D | L | N | D | S | H | V | Q | I | 18 | 2996 |
| 102 | P | L | P | L | A | Y | A | V | L | 18 | 2997 |
| 162 | D | V | Q | D | N | C | D | Q | H | 18 | 2998 |
| 228 | H | V | L | G | Q | D | K | V | S | 18 | 2999 |
| 289 | V | V | F | R | V | A | P | W | I | 18 | 3000 |
| 312 | R | V | R | N | N | T | C | F | V | 18 | 3001 |
| 322 | A | V | A | E | L | A | R | K | A | 18 | 3002 |
| 335 | T | I | C | P | Q | A | E | N | R | 18 | 3003 |
| 353 | E | L | G | Y | V | Q | A | P | H | 18 | 3004 |
| 391 | Y | V | T | R | E | P | R | D | R | 18 | 3005 |
| 411 | E | V | S | P | P | V | V | A | N | 18 | 3006 |
| 444 | Q | V | V | R | D | F | L | H | A | 18 | 3007 |
| 490 | L | A | S | P | G | A | C | F | K | 18 | 3008 |
| 591 | L | V | L | G | K | H | L | G | I | 18 | 3009 |
| 103 | L | P | L | A | Y | A | V | L | Y | 17 | 3010 |
| 184 | V | L | R | T | Q | G | P | A | A | 17 | 3011 |
| 253 | G | L | S | F | P | D | A | G | F | 17 | 3012 |
| 302 | T | L | P | P | L | E | V | Y | V | 17 | 3013 |
| 354 | L | G | Y | V | Q | A | P | H | K | 17 | 3014 |
| 433 | N | L | P | G | S | S | G | R | R | 17 | 3015 |
| 465 | W | L | A | V | G | H | V | D | E | 17 | 3016 |
| 488 | M | L | L | A | S | P | G | A | C | 17 | 3017 |
| 553 | E | V | L | K | R | E | L | G | L | 17 | 3018 |
| 565 | D | I | I | D | I | P | Q | L | F | 17 | 3019 |
| 22 | G | V | E | T | L | V | D | I | Y | 16 | 3020 |
| 73 | T | L | E | I | I | V | V | M | N | 16 | 3021 |
| 122 | D | L | N | C | E | G | R | Q | D | 16 | 3022 |
| 133 | F | V | D | K | R | Q | W | V | W | 16 | 3023 |
| 148 | G | I | L | L | V | N | C | D | R | 16 | 3024 |
| 176 | D | L | E | D | M | S | V | M | V | 16 | 3025 |
| 181 | S | V | M | V | L | R | T | Q | G | 16 | 3026 |
| 183 | M | V | L | R | T | Q | G | P | A | 16 | 3027 |
| 186 | R | T | Q | G | P | A | A | L | F | 16 | 3028 |
| 248 | R | F | E | V | E | G | L | S | F | 16 | 3029 |
| 301 | S | T | L | P | P | L | E | V | Y | 16 | 3030 |
| 319 | F | V | D | A | V | A | E | L | A | 16 | 3031 |
| 333 | K | L | T | I | C | P | Q | A | E | 16 | 3032 |
| 356 | Y | V | Q | A | P | H | K | T | L | 16 | 3033 |
| 375 | E | L | Q | Q | D | F | P | Y | K | R | 16 | 3034 |
| 384 | I | L | G | P | D | F | G | Y | V | 16 | 3035 |
| 400 | S | V | S | G | L | D | S | F | G | 16 | 3036 |
| 446 | V | R | D | F | L | H | A | Q | K | 16 | 3037 |
| 512 | L | L | E | Q | G | V | D | D | I | 16 | 3038 |
| 616 | K | V | R | S | L | L | E | P | L | 16 | 3039 |
| 643 | E | V | H | C | G | T | N | V | C | 16 | 3040 |
| 650 | V | C | R | K | P | F | S | F | K | 16 | 3041 |
| 6 | I | V | R | V | S | L | E | H | P | 15 | 3042 |
| 10 | S | L | E | H | P | T | S | A | V | 15 | 3043 |
| 19 | C | V | A | G | V | E | T | L | V | 15 | 3044 |
| 49 | D | I | Y | I | S | P | N | M | E | 15 | 3045 |
| 78 | V | V | M | N | S | P | S | N | D | 15 | 3046 |
| 99 | S | H | E | P | L | P | L | A | Y | 15 | 3047 |
| 199 | L | V | L | H | T | S | S | Y | D | 15 | 3048 |
| 271 | L | L | D | D | S | N | E | D | F | 15 | 3049 |
| 288 | T | V | V | F | R | V | A | P | W | 15 | 3050 |
| 309 | Y | V | C | R | V | R | N | P | T | 15 | 3051 |
| 321 | D | A | V | A | E | L | A | R | K | 15 | 3052 |
| 394 | R | E | P | R | D | R | S | V | S | 15 | 3053 |
| 409 | N | L | E | V | S | P | P | V | V | 15 | 3054 |
| 413 | S | P | P | V | V | A | N | G | K | 15 | 3055 |
| 439 | G | R | R | V | T | Q | V | V | R | 15 | 3056 |
| 445 | V | V | R | D | F | L | H | A | Q | 15 | 3057 |
| 474 | F | L | S | F | V | P | A | P | D | 15 | 3058 |
| 476 | S | F | V | P | A | P | D | G | K | 15 | 3059 |
| 497 | F | K | L | F | Q | E | K | Q | L | 15 | 3060 |
| 517 | V | V | D | D | E | Q | V | K | T | 15 | 3061 |
| 531 | V | L | S | N | K | D | L | I | N | 15 | 3062 |
| 538 | I | N | Y | N | K | F | V | Q | S | 15 | 3063 |
| 554 | V | L | K | R | E | L | G | L | A | 15 | 3064 |
| 586 | D | L | V | N | M | L | V | L | G | 15 | 3065 |
| 25 | T | L | V | D | I | Y | G | S | V | 14 | 3066 |
| 28 | D | I | Y | G | S | V | P | E | G | 14 | 3067 |
| 47 | G | V | D | I | Y | I | S | P | N | 14 | 3068 |
| 66 | R | R | W | R | F | D | A | T | L | 14 | 3069 |
| 72 | A | T | L | E | I | I | V | V | M | 14 | 3070 |
| 75 | E | I | I | V | V | M | N | S | P | 14 | 3071 |
| 77 | I | V | V | M | N | S | P | S | N | 14 | 3072 |
| 104 | P | L | A | Y | A | V | L | Y | L | 14 | 3073 |
| 138 | Q | W | V | W | G | P | S | G | Y | 14 | 3074 |
| 149 | I | L | L | V | N | C | D | R | D | 14 | 3075 |
| 192 | A | L | F | D | D | H | K | L | V | 14 | 3076 |
| 206 | Y | D | K | R | A | Q | V | F | 14 | 3077 |
| 215 | H | I | C | G | P | E | D | V | C | 14 | 3078 |
| 238 | E | V | P | R | L | H | G | D | E | 14 | 3079 |
| 328 | R | K | A | G | C | K | L | T | I | 14 | 3080 |
| 360 | P | H | K | T | L | P | V | V | F | 14 | 3081 |
| 386 | G | P | D | F | G | Y | V | T | R | 14 | 3082 |
| 416 | V | V | A | N | G | K | E | Y | P | 14 | 3083 |
| 432 | G | N | L | P | G | S | S | G | R | 14 | 3084 |
| 460 | E | L | F | V | D | W | L | A | V | 14 | 3085 |
| 467 | A | V | G | H | V | D | E | F | L | 14 | 3086 |
| 470 | H | V | D | E | F | L | S | F | V | 14 | 3087 |
| 506 | C | G | H | G | R | A | L | L | F | 14 | 3088 |
| 530 | Q | V | L | S | N | K | D | L | I | 14 | 3089 |
| 536 | D | L | I | N | Y | N | K | F | V | 14 | 3090 |
| 574 | K | T | E | R | K | K | A | T | A | 14 | 3091 |
| 593 | L | G | K | H | L | G | I | P | K | 14 | 3092 |
| 605 | P | I | I | N | G | C | C | S | L | 14 | 3093 |
| 612 | C | L | E | E | K | V | R | S | L | 14 | 3094 |
| 76 | I | I | V | V | M | N | S | P | S | 13 | 3095 |
| 91 | H | V | Q | I | S | Y | H | S | S | 13 | 3096 |
| 93 | Q | I | S | Y | H | S | S | H | E | 13 | 3097 |
| 111 | Y | L | T | C | V | D | I | S | L | 13 | 3098 |
| 139 | W | V | W | G | P | S | G | Y | G | 13 | 3099 |
| 212 | Q | V | F | H | I | C | G | P | E | 13 | 3100 |
| 226 | Y | R | H | V | L | G | Q | D | K | 13 | 3101 |
| 234 | K | V | S | Y | E | V | P | R | L | 13 | 3102 |
| 268 | H | V | T | L | L | D | D | S | N | 13 | 3103 |
| 270 | T | L | L | D | D | S | N | E | D | 13 | 3104 |
| 363 | T | L | P | V | V | F | D | S | P | 13 | 3105 |
| 370 | S | P | R | N | G | E | L | Q | D | 13 | 3106 |
| 403 | G | L | D | S | F | G | N | L | E | 13 | 3107 |
| 421 | K | E | Y | P | L | G | R | I | L | 13 | 3108 |
| 424 | P | L | G | R | I | L | I | G | G | 13 | 3109 |
| 436 | G | S | S | G | R | R | V | T | Q | 13 | 3110 |
| 477 | F | V | P | A | P | D | G | K | G | 13 | 3111 |
| 495 | A | C | F | K | L | F | Q | E | K | 13 | 3112 |
| 498 | K | L | F | Q | E | K | Q | K | C | 13 | 3113 |
| 522 | Q | V | K | T | I | S | I | N | Q | 13 | 3114 |
| 525 | T | I | S | I | N | Q | V | L | S | 13 | 3115 |
| 547 | C | I | D | W | N | R | E | V | L | 13 | 3116 |
| 570 | P | Q | L | F | K | T | E | R | K | 13 | 3117 |
| 575 | T | E | R | K | K | A | T | A | F | 13 | 3118 |
| 590 | M | L | V | L | G | K | H | L | G | 13 | 3119 |
| 630 | F | I | D | D | F | T | P | Y | H | 13 | 3120 |
| 3 | L | Q | R | I | V | R | V | S | L | 12 | 3121 |
| 92 | V | Q | I | S | Y | H | S | S | H | 12 | 3122 |
| 144 | S | G | Y | G | G | I | L | S | V | 12 | 3123 |
| 173 | C | L | Q | D | L | E | D | M | S | 12 | 3124 |
| 175 | Q | D | L | E | D | M | S | V | M | 12 | 3125 |
| 190 | P | A | L | F | D | D | H | K | L | 12 | 3126 |
| 207 | D | A | K | R | A | Q | V | F | H | 12 | 3127 |
| 250 | F | V | E | G | L | S | F | P | D | 12 | 3128 |
| 304 | P | P | L | E | V | Y | V | C | R | 12 | 3129 |
| 324 | A | E | L | A | R | K | A | G | C | 12 | 3130 |
| 348 | I | Q | D | E | M | E | L | G | Y | 12 | 131 |
| 366 | V | V | F | D | S | P | R | N | G | 12 | 3132 |
| 374 | G | E | L | Q | D | F | P | Y | K | 12 | 3133 |
| 395 | E | P | R | D | R | S | V | S | G | 12 | 3134 |
| 399 | R | S | V | S | G | L | D | S | F | 12 | 3135 |
| 438 | S | G | R | R | V | T | Q | V | V | 12 | 3136 |
| 458 | P | V | E | L | F | V | D | W | L | 12 | 3137 |
| 464 | D | W | L | A | V | G | H | V | D | 12 | 3138 |
| 510 | R | A | L | L | F | Q | G | V | V | 12 | 3139 |

TABLE XXVI-continued

| Pos | 1 | 2 | 3 | 4 | 5 | 6 | 7 | 8 | 9 | score | SEQ. ID NO. |
|---|---|---|---|---|---|---|---|---|---|---|---|
| 537 | L | I | N | Y | N | K | F | V | Q | 12 | 3140 |
| 560 | G | L | A | E | C | D | I | I | D | 12 | 3141 |
| 568 | D | I | P | Q | L | F | K | T | E | 12 | 3142 |
| 595 | K | H | L | G | I | P | K | P | F | 12 | 3143 |
| 606 | I | I | N | G | C | C | L | E | 12 | | 3144 |
| 622 | E | P | L | G | L | H | C | T | F | 12 | 3145 |
| 623 | P | L | G | L | H | C | T | F | I | 12 | 3146 |
| 637 | Y | H | M | L | H | G | E | V | H | 12 | 3147 |
| 639 | M | L | H | G | E | V | H | C | G | 12 | 3148 |
| 35 | E | G | T | E | M | F | E | V | Y | 11 | 3149 |
| 43 | Y | G | T | P | C | V | D | I | Y | 11 | 3150 |
| 51 | Y | I | S | P | N | M | E | R | G | 11 | 3151 |
| 62 | R | A | D | T | R | R | W | R | F | 11 | 3152 |
| 67 | R | W | R | F | D | A | T | L | E | 11 | 3153 |
| 106 | A | Y | A | V | L | Y | L | T | C | 11 | 3154 |
| 114 | C | V | D | I | S | L | D | C | D | 11 | 3155 |
| 118 | S | L | D | C | D | L | N | C | E | 11 | 3156 |
| 150 | L | L | V | N | C | D | R | D | D | 11 | 3157 |
| 151 | L | V | N | C | D | R | D | D | P | 11 | 3158 |
| 156 | R | D | D | P | S | C | D | V | Q | 11 | 3159 |
| 201 | L | H | T | S | S | Y | D | A | K | 11 | 3160 |
| 205 | S | Y | D | A | K | R | A | Q | V | 11 | 3161 |
| 221 | D | V | C | E | A | Y | R | H | V | 11 | 3162 |
| 225 | A | Y | R | H | V | L | G | Q | D | 11 | 3163 |
| 235 | V | S | Y | E | V | P | R | L | H | 11 | 3164 |
| 259 | A | G | F | T | G | L | I | S | F | 11 | 3165 |
| 284 | I | F | T | D | T | V | V | F | R | 11 | 3166 |
| 295 | P | W | I | M | T | P | S | T | L | 11 | 3167 |
| 381 | Y | K | R | I | L | G | P | D | F | 11 | 3168 |
| 478 | V | P | A | P | D | G | K | G | F | 11 | 3169 |
| 526 | I | S | I | N | Q | V | L | S | N | 11 | 3170 |
| 534 | N | K | D | L | I | N | Y | N | K | 11 | 3171 |
| 543 | F | V | Q | S | C | I | D | W | N | 11 | 3172 |
| 555 | L | K | R | E | L | G | L | A | E | 11 | 3173 |
| 557 | R | E | L | G | L | A | E | C | D | 11 | 3174 |
| 558 | E | L | G | L | A | E | C | D | I | 11 | 3175 |
| 592 | V | L | G | K | H | L | G | I | P | 11 | 3176 |
| 596 | H | L | G | I | P | K | P | F | G | 11 | 3177 |
| 618 | R | S | L | L | E | P | L | G | L | 11 | 3178 |
| 629 | T | F | I | D | D | F | T | P | Y | 11 | 3179 |
| 4 | Q | R | I | V | R | V | S | L | E | 10 | 3180 |
| 11 | L | E | H | P | T | S | A | V | C | 10 | 3181 |
| 16 | S | A | V | C | V | A | G | V | E | 10 | 3182 |
| 50 | I | Y | I | S | P | N | M | E | R | 10 | 3183 |
| 54 | P | N | M | E | R | G | R | E | R | 10 | 3184 |
| 129 | Q | D | R | N | F | V | D | K | R | 10 | 3185 |
| 164 | Q | D | N | N | C | D | Q | H | V | H | 10 | 3186 |
| 170 | H | V | H | C | L | Q | D | L | E | 10 | 3187 |
| 200 | V | L | H | T | S | S | Y | D | A | 10 | 3188 |
| 224 | E | A | Y | R | H | V | L | C | Q | 10 | 3189 |
| 305 | P | L | E | V | Y | Y | V | C | R | V | 10 | 3190 |
| 351 | E | M | E | L | G | Y | V | Q | A | 10 | 3191 |
| 365 | P | V | V | F | D | S | P | R | N | 10 | 3192 |
| 382 | K | R | I | L | G | P | D | F | G | 10 | 3193 |
| 419 | N | G | K | E | Y | P | L | G | R | 10 | 3194 |
| 429 | L | I | G | G | N | L | P | G | S | 10 | 3195 |
| 437 | S | S | G | R | R | V | T | Q | V | 10 | 3196 |
| 469 | G | H | V | D | E | F | L | S | F | 10 | 3197 |
| 484 | K | G | E | R | M | L | L | A | S | 10 | 3198 |
| 524 | K | T | I | S | I | N | Q | V | L | 10 | 3199 |
| 535 | K | D | L | I | N | Y | N | K | F | 10 | 3200 |
| 549 | D | W | N | R | E | V | L | K | R | 10 | 3201 |
| 577 | R | K | K | A | T | F | F | P | 10 | | 3202 |
| 582 | A | F | F | P | D | L | V | N | M | 10 | 3203 |
| 608 | N | G | C | C | C | L | E | E | K | 10 | 3204 |
| 625 | G | L | H | C | T | F | I | D | D | 10 | 3205 |
| 644 | V | H | C | G | T | N | V | C | R | 10 | 3206 |
| 645 | H | C | C | T | N | V | R | R | K | 10 | 3207 |
| 27 | V | D | I | Y | G | S | V | P | E | 9 | 3208 |
| 60 | R | E | R | A | D | T | R | R | W | 9 | 3209 |
| 88 | N | D | S | H | V | Q | I | S | Y | 9 | 3210 |
| 101 | E | P | L | E | L | A | Y | A | V | 9 | 3211 |
| 116 | D | I | S | L | D | C | D | L | N | 9 | 3212 |
| 134 | V | D | K | R | Q | W | V | W | G | 9 | 3213 |
| 137 | R | Q | W | V | W | G | P | S | G | 9 | 3214 |
| 145 | G | Y | G | G | I | L | L | V | N | 9 | 3215 |
| 178 | E | D | M | S | V | M | V | L | R | 9 | 3216 |
| 187 | T | Q | G | P | A | A | L | F | D | 9 | 3217 |
| 194 | F | D | D | H | K | L | V | L | H | 9 | 3218 |
| 216 | I | C | G | P | E | D | V | C | E | 9 | 3219 |
| 218 | G | P | E | D | V | C | E | A | Y | 9 | 3220 |
| 255 | S | F | P | D | A | G | F | T | G | 9 | 3221 |
| 260 | G | F | T | G | L | I | S | F | H | 9 | 3222 |
| 264 | L | I | S | F | H | V | T | L | L | 9 | 3223 |
| 282 | S | P | I | F | T | D | T | V | V | 9 | 3224 |
| 296 | W | I | M | T | P | S | T | L | P | 9 | 3225 |
| 306 | L | E | V | Y | Y | V | C | R | V | R | 9 | 3226 |
| 310 | V | C | R | V | R | N | N | T | C | 9 | 3227 |
| 320 | V | D | A | V | A | E | L | A | R | 9 | 3228 |
| 347 | W | I | Q | D | E | M | E | L | G | 9 | 3229 |
| 362 | K | T | L | P | V | V | F | D | S | 9 | 3230 |
| 379 | F | P | Y | K | R | I | L | G | P | 9 | 3231 |
| 389 | F | G | Y | V | T | R | E | P | R | 9 | 3232 |
| 397 | R | D | R | S | V | S | G | L | D | 9 | 3233 |
| 410 | L | E | V | S | P | P | V | V | A | 9 | 3234 |
| 423 | Y | P | L | G | R | I | L | I | G | 9 | 3235 |
| 431 | G | G | N | L | P | G | S | S | G | 9 | 3236 |
| 452 | A | Q | K | V | Q | P | P | V | E | 9 | 3237 |
| 480 | A | P | D | G | K | G | F | R | M | 9 | 3238 |
| 505 | K | C | G | H | G | R | A | L | L | 9 | 3239 |
| 556 | K | R | E | L | G | L | A | E | C | 9 | 3240 |
| 585 | P | D | L | V | N | M | L | V | L | 9 | 3241 |
| 598 | G | I | P | K | P | F | G | P | I | 9 | 3242 |
| 599 | I | P | K | P | F | G | P | I | I | 9 | 3243 |
| 610 | C | C | C | L | E | E | K | V | R | 9 | 3244 |
| 1 | M | S | L | Q | R | I | V | R | V | 8 | 3245 |
| 14 | P | T | S | A | V | C | V | A | G | 8 | 3246 |
| 18 | V | C | V | A | G | V | E | T | L | 8 | 3247 |
| 21 | A | G | V | E | T | L | V | D | I | 8 | 3248 |
| 56 | M | E | R | G | R | E | R | A | D | 8 | 3249 |
| 59 | G | R | E | R | A | D | T | R | R | 8 | 3250 |
| 61 | E | R | A | D | T | R | R | W | R | 8 | 3251 |
| 63 | A | D | T | R | R | W | R | F | D | 8 | 3252 |
| 117 | I | S | L | D | C | D | L | N | C | 8 | 3253 |
| 123 | L | N | C | E | G | R | Q | D | R | 8 | 3254 |
| 154 | C | D | R | D | D | P | S | C | D | 8 | 3255 |
| 193 | L | F | D | D | H | K | L | V | L | 8 | 3256 |
| 208 | A | K | R | A | Q | V | F | H | I | 8 | 3257 |
| 233 | D | K | V | S | Y | E | V | P | R | 8 | 3258 |
| 240 | P | R | L | H | G | D | E | E | R | 8 | 3259 |
| 281 | A | S | P | I | F | T | D | T | V | 8 | 3260 |
| 297 | I | M | T | P | S | T | L | P | P | 8 | 3261 |
| 311 | C | R | V | R | N | N | T | C | F | 8 | 3262 |
| 314 | R | N | N | T | C | F | V | D | A | 8 | 3263 |
| 316 | N | T | C | F | V | D | A | V | A | 8 | 3264 |
| 317 | T | C | F | V | D | A | V | A | E | 8 | 3265 |
| 327 | A | R | K | A | G | C | K | L | T | 8 | 3266 |
| 346 | R | W | I | Q | D | E | M | E | L | 8 | 3267 |
| 350 | D | E | M | E | L | G | Y | V | Q | 8 | 3268 |
| 385 | L | G | P | D | F | G | Y | V | T | 8 | 3269 |
| 406 | S | F | G | N | L | E | V | S | P | 8 | 3270 |
| 426 | G | R | I | L | I | G | G | N | L | 8 | 3271 |
| 440 | R | R | V | T | Q | V | V | R | D | 8 | 3272 |
| 447 | R | D | F | L | H | A | Q | K | V | 8 | 3273 |
| 461 | L | F | V | D | W | L | A | V | G | 8 | 3274 |
| 479 | P | A | P | D | C | K | G | F | R | 8 | 3275 |
| 485 | G | F | R | M | L | L | A | S | P | 8 | 3276 |
| 504 | Q | K | C | G | H | G | R | A | L | 8 | 3277 |
| 508 | H | G | R | A | L | L | E | G | G | 8 | 3278 |
| 567 | I | D | I | P | Q | L | F | K | T | 8 | 3279 |
| 569 | I | P | Q | L | F | K | T | E | R | 8 | 3280 |
| 576 | E | R | K | K | A | T | A | F | F | 8 | 3281 |
| 597 | L | G | I | P | K | P | F | G | P | 8 | 3282 |
| 633 | D | F | T | P | Y | H | M | L | H | 8 | 3283 |
| 638 | H | M | L | H | G | E | V | H | C | 8 | 3284 |
| 9 | V | S | L | E | H | P | T | S | A | 7 | 3285 |
| 12 | E | H | P | T | S | A | V | C | V | 7 | 3286 |
| 20 | V | A | G | V | E | T | L | V | D | 7 | 3287 |
| 31 | G | S | V | P | E | G | T | E | M | 7 | 3288 |
| 38 | E | M | F | E | V | Y | G | T | P | 7 | 3289 |
| 42 | V | Y | G | T | P | G | V | D | I | 7 | 3290 |
| 52 | I | S | P | N | M | E | R | G | R | 7 | 3291 |

TABLE XXVI-continued

| Pos | 1 | 2 | 3 | 4 | 5 | 6 | 7 | 8 | 9 | score | SEQ. ID NO. |
|---|---|---|---|---|---|---|---|---|---|---|---|
| 57 | E | R | G | R | E | R | A | D | T | 7 | 3292 |
| 64 | D | T | R | R | W | R | F | D | A | 7 | 3293 |
| 83 | P | S | N | D | L | N | D | S | H | 7 | 3294 |
| 85 | N | D | L | N | D | S | H | V | Q | 7 | 3295 |
| 89 | D | S | H | V | Q | I | S | Y | H | 7 | 3296 |
| 105 | L | A | Y | A | V | L | Y | L | T | 7 | 3297 |
| 125 | C | E | G | R | Q | D | R | N | F | 7 | 3298 |
| 127 | G | R | Q | D | R | N | F | V | D | 7 | 3299 |
| 131 | R | N | E | V | D | K | R | Q | W | 7 | 3300 |
| 157 | D | D | P | S | C | D | V | Q | D | 7 | 3301 |
| 185 | L | R | T | Q | G | P | A | A | L | 7 | 3302 |
| 189 | G | P | A | A | L | F | D | D | H | 7 | 3303 |
| 196 | D | H | K | L | V | L | H | T | S | 7 | 3304 |
| 202 | H | T | S | S | Y | D | A | K | R | 7 | 3305 |
| 204 | S | S | Y | D | A | K | R | A | Q | 7 | 3306 |
| 219 | P | E | D | V | C | E | A | Y | R | 7 | 3307 |
| 220 | E | D | V | C | E | A | Y | R | H | 7 | 3308 |
| 222 | V | C | E | A | Y | R | H | V | L | 7 | 3309 |
| 223 | C | E | A | Y | R | H | V | L | G | 7 | 3310 |
| 227 | R | H | V | L | G | Q | D | K | V | 7 | 3311 |
| 232 | Q | D | K | V | S | Y | E | V | P | 7 | 3312 |
| 239 | V | P | R | L | H | G | D | E | E | 7 | 3313 |
| 244 | G | D | E | E | R | F | F | V | E | 7 | 3314 |
| 245 | D | E | E | R | F | F | V | E | G | 7 | 3315 |
| 254 | L | S | F | P | D | A | G | F | T | 7 | 3316 |
| 262 | T | G | L | I | S | F | H | V | T | 7 | 3317 |
| 275 | S | N | E | D | F | S | A | S | P | 7 | 3318 |
| 338 | P | Q | A | E | N | R | N | D | R | 7 | 3319 |
| 340 | A | E | N | R | N | D | R | W | I | 7 | 3320 |
| 343 | R | N | D | R | W | I | Q | D | E | 7 | 3321 |
| 359 | A | P | H | K | T | L | P | V | V | 7 | 3322 |
| 364 | L | P | V | V | F | D | S | P | R | 7 | 3323 |
| 373 | N | G | E | L | Q | D | F | P | Y | 7 | 3324 |
| 393 | T | R | E | P | R | D | R | S | V | 7 | 3325 |
| 412 | V | S | P | P | V | V | A | N | G | 7 | 3326 |
| 430 | I | G | G | N | L | P | G | S | S | 7 | 3327 |
| 435 | P | G | S | S | G | R | R | V | T | 7 | 3328 |
| 453 | Q | K | V | Q | P | P | V | E | L | 7 | 3329 |
| 455 | V | Q | P | P | V | E | L | F | V | 7 | 3330 |
| 486 | F | R | M | L | L | A | S | P | G | 7 | 3331 |
| 487 | R | M | L | L | A | S | P | G | A | 7 | 3332 |
| 492 | S | P | G | A | C | E | K | L | F | 7 | 3333 |
| 502 | E | K | Q | K | C | G | H | G | R | 7 | 3334 |
| 503 | K | Q | K | C | G | H | G | R | A | 7 | 3335 |
| 552 | R | E | V | L | K | R | E | L | G | 7 | 3336 |
| 564 | C | D | I | I | D | I | P | Q | L | 7 | 3337 |
| 581 | T | A | F | F | P | D | L | V | N | 7 | 3338 |
| 588 | V | N | M | L | V | L | G | K | H | 7 | 3339 |
| 604 | G | P | I | I | N | G | C | C | C | 7 | 3340 |
| 611 | C | C | L | E | E | K | V | R | S | 7 | 3341 |
| 656 | S | F | K | W | W | N | M | V | P | 7 | 3342 |
| 55 | N | M | E | R | G | R | E | R | A | 6 | 3343 |
| 65 | T | R | R | W | R | F | D | A | T | 6 | 3344 |
| 69 | R | F | D | A | T | L | E | I | I | 6 | 3345 |
| 74 | L | E | I | I | V | V | M | N | S | 6 | 3346 |
| 94 | I | S | Y | H | S | S | H | E | P | 6 | 3347 |
| 140 | V | W | G | P | S | G | Y | G | G | 6 | 3348 |
| 142 | G | P | S | G | Y | G | G | I | L | 6 | 3349 |
| 168 | D | Q | H | V | H | C | L | Q | D | 6 | 3350 |
| 214 | F | H | I | C | G | P | E | D | V | 6 | 3351 |
| 249 | F | F | V | E | G | L | S | F | P | 6 | 3352 |
| 258 | D | A | G | F | T | G | L | I | S | 6 | 3353 |
| 265 | I | S | F | N | V | T | L | L | D | 6 | 3354 |
| 269 | V | T | L | L | D | D | S | N | E | 6 | 3355 |
| 276 | N | E | D | F | S | A | S | P | I | 6 | 3356 |
| 287 | D | T | V | V | F | R | V | A | P | 6 | 3357 |
| 294 | A | P | W | I | M | T | P | S | T | 6 | 3358 |
| 326 | L | A | R | K | A | G | C | K | L | 6 | 3359 |
| 334 | L | T | I | C | P | Q | A | E | N | 6 | 3360 |
| 342 | N | R | N | D | R | W | I | Q | D | 6 | 3361 |
| 358 | Q | A | P | H | K | T | L | P | V | 6 | 3362 |
| 368 | F | D | S | P | R | N | G | E | L | 6 | 3363 |
| 369 | D | S | P | R | N | G | E | L | Q | 6 | 3364 |
| 371 | P | R | N | G | E | L | Q | D | F | 6 | 3365 |
| 396 | P | R | D | R | S | V | S | G | L | 6 | 3366 |
| 398 | D | R | S | V | S | G | L | D | S | 6 | 3367 |
| 405 | D | S | F | G | N | L | E | V | S | 6 | 3368 |
| 443 | T | Q | V | V | R | D | F | L | H | 6 | 3369 |
| 448 | D | F | L | H | A | Q | K | V | Q | 6 | 3370 |
| 456 | Q | P | P | V | E | L | F | V | D | 6 | 3371 |
| 466 | L | A | V | G | H | V | D | E | F | 6 | 3372 |
| 507 | G | H | G | R | A | L | L | F | Q | 6 | 3373 |
| 532 | L | S | N | K | D | L | I | N | Y | 6 | 3374 |
| 614 | E | E | K | V | R | S | L | L | E | 6 | 3375 |
| 615 | E | K | V | R | S | L | L | E | P | 6 | 3376 |
| 30 | Y | G | S | V | P | E | G | T | E | 5 | 3377 |
| 71 | D | A | T | L | E | I | I | V | V | 5 | 3378 |
| 84 | S | N | D | L | N | D | S | H | V | 5 | 3379 |
| 120 | D | C | D | L | N | C | E | G | R | 5 | 3380 |
| 136 | K | R | Q | W | V | W | G | P | S | 5 | 3381 |
| 143 | P | S | G | Y | G | G | I | L | L | 5 | 3382 |
| 146 | Y | G | G | I | L | L | V | N | C | 5 | 3383 |
| 153 | N | C | D | R | D | D | P | S | C | 5 | 3384 |
| 165 | D | N | C | D | Q | H | V | H | C | 5 | 3385 |
| 177 | L | E | D | M | S | V | M | V | L | 5 | 3386 |
| 180 | M | S | V | M | V | L | R | T | Q | 5 | 3387 |
| 191 | A | A | L | F | D | D | H | K | L | 5 | 3388 |
| 197 | H | K | L | V | L | H | T | S | S | 5 | 3389 |
| 209 | K | R | A | Q | V | F | H | I | C | 5 | 3390 |
| 230 | L | G | Q | D | K | V | S | Y | E | 5 | 3391 |
| 236 | S | Y | E | V | P | R | L | H | G | 5 | 3392 |
| 237 | Y | E | V | P | R | L | H | G | D | 5 | 3393 |
| 242 | L | H | G | D | E | E | R | F | F | 5 | 3394 |
| 256 | F | P | D | A | G | F | T | G | L | 5 | 3395 |
| 274 | D | S | N | E | D | F | S | A | S | 5 | 3396 |
| 279 | F | S | A | S | P | I | F | T | D | 5 | 3397 |
| 280 | S | A | S | P | I | F | T | D | T | 5 | 3398 |
| 286 | T | D | T | V | V | F | R | V | A | 5 | 3399 |
| 300 | P | S | T | L | P | P | L | E | V | 5 | 3400 |
| 303 | L | P | P | L | E | V | Y | V | C | 5 | 3401 |
| 313 | V | R | N | T | C | F | V | D | 5 | 3402 |
| 329 | K | A | G | C | K | L | T | I | C | 5 | 3403 |
| 332 | C | K | L | T | I | C | P | Q | A | 5 | 3404 |
| 339 | Q | A | E | N | R | N | D | R | W | 5 | 3405 |
| 341 | E | N | R | N | D | R | W | I | Q | 5 | 3406 |
| 352 | M | E | L | G | Y | Y | V | Q | A | 5 | 3407 |
| 357 | V | Q | A | P | H | K | T | L | P | 5 | 3408 |
| 361 | H | K | T | L | P | V | V | F | D | 5 | 3409 |
| 372 | R | N | G | E | L | Q | D | F | P | 5 | 3410 |
| 377 | Q | D | F | P | Y | K | R | I | L | 5 | 3411 |
| 380 | P | Y | K | R | I | L | G | P | D | 5 | 3412 |
| 392 | V | T | R | E | P | R | D | R | S | 5 | 3413 |
| 402 | S | G | L | D | S | F | G | N | L | 5 | 3414 |
| 404 | L | D | S | F | G | N | L | E | V | 5 | 3415 |
| 425 | L | G | R | I | L | I | G | G | N | 5 | 3416 |
| 457 | P | P | V | E | L | F | V | D | W | 5 | 3417 |
| 472 | D | E | F | L | S | F | V | P | A | 5 | 3418 |
| 482 | D | G | K | G | F | R | M | L | L | 5 | 3419 |
| 483 | G | K | G | F | R | M | L | L | A | 5 | 3420 |
| 491 | A | S | P | G | A | C | F | K | L | 5 | 3421 |
| 501 | Q | E | K | Q | K | C | G | H | G | 5 | 3422 |
| 515 | Q | G | G | V | Q | D | E | Q | V | 5 | 3423 |
| 518 | V | D | D | E | Q | V | K | T | I | 5 | 3424 |
| 540 | Y | N | K | F | V | Q | S | C | I | 5 | 3425 |
| 546 | S | C | I | D | W | N | L | K | E | V | 5 | 3426 |
| 550 | W | N | L | R | E | V | L | K | R | E | 5 | 3427 |
| 579 | K | A | T | A | F | F | P | D | L | 5 | 3428 |
| 580 | A | T | A | F | F | P | D | L | V | 5 | 3429 |
| 589 | N | M | L | V | L | G | K | H | L | 5 | 3430 |
| 601 | K | P | F | G | P | I | I | N | G | 5 | 3431 |
| 607 | I | N | G | C | C | C | L | E | E | 5 | 3432 |
| 613 | L | E | E | K | V | R | S | L | L | 5 | 3433 |
| 628 | C | T | F | I | D | D | E | T | P | 5 | 3434 |
| 641 | H | G | E | V | H | C | D | G | T | N | 5 | 3435 |
| 647 | G | T | N | V | C | R | K | P | F | 5 | 3436 |
| 652 | R | K | P | F | S | F | K | W | W | 5 | 3437 |
| 13 | H | P | T | S | A | V | C | V | A | 4 | 3438 |
| 15 | T | S | A | V | C | V | A | G | V | 4 | 3439 |
| 29 | I | Y | G | S | V | P | E | G | T | 4 | 3440 |
| 36 | G | T | E | M | F | E | V | Y | G | 4 | 3441 |
| 39 | M | F | E | V | Y | G | T | P | G | 4 | 3442 |
| 68 | W | R | F | D | A | T | L | E | I | 4 | 3443 |

TABLE XXVI-continued

| Pos | 1 | 2 | 3 | 4 | 5 | 6 | 7 | 8 | 9 | score | SEQ. ID NO. |
|---|---|---|---|---|---|---|---|---|---|---|---|
| 97 | H | S | S | H | E | P | L | P | L | 4 | 3444 |
| 100 | H | E | P | L | P | L | A | Y | A | 4 | 3445 |
| 113 | T | C | V | D | I | S | L | D | C | 4 | 3446 |
| 121 | C | D | L | N | C | E | G | R | Q | 4 | 3447 |
| 124 | N | C | E | G | R | Q | D | R | N | 4 | 3448 |
| 126 | E | G | R | Q | D | R | N | F | V | 4 | 3449 |
| 132 | N | F | V | D | K | R | Q | W | V | 4 | 3450 |
| 147 | G | G | I | L | L | V | N | C | D | 4 | 3451 |
| 171 | V | H | C | L | Q | D | L | E | D | 4 | 3452 |
| 174 | L | Q | D | L | E | D | M | S | V | 4 | 3453 |
| 188 | Q | G | P | A | A | L | F | D | D | 4 | 3454 |
| 210 | R | A | Q | V | F | H | I | C | G | 4 | 3455 |
| 213 | V | F | H | I | C | G | P | E | D | 4 | 3456 |
| 252 | E | G | L | S | F | P | D | A | G | 4 | 3457 |
| 257 | P | D | A | G | F | T | G | L | I | 4 | 3458 |
| 266 | S | F | H | V | T | L | L | D | D | 4 | 3459 |
| 277 | E | D | F | S | A | S | P | I | F | 4 | 3460 |
| 290 | V | F | R | V | A | P | W | I | M | 4 | 3461 |
| 318 | C | F | V | D | A | V | A | E | L | 4 | 3462 |
| 407 | F | G | N | L | E | V | S | P | P | 4 | 3463 |
| 408 | G | N | L | E | V | S | P | P | V | 4 | 3464 |
| 422 | E | Y | P | L | G | R | I | L | I | 4 | 3465 |
| 471 | V | D | E | F | L | S | F | V | P | 4 | 3466 |
| 493 | P | G | A | C | F | K | L | F | Q | 4 | 3467 |
| 494 | G | A | C | F | K | L | F | Q | E | 4 | 3468 |
| 500 | F | Q | E | K | Q | K | C | G | H | 4 | 3469 |
| 523 | V | K | T | I | S | I | N | Q | V | 4 | 3470 |
| 544 | V | Q | S | C | I | D | W | N | R | 4 | 3471 |
| 559 | L | G | L | A | E | C | D | I | I | 4 | 3472 |
| 562 | A | E | C | D | I | I | D | I | P | 4 | 3473 |
| 573 | F | K | T | E | R | K | K | A | T | 4 | 3474 |
| 578 | K | K | A | T | A | F | F | P | D | 4 | 3475 |
| 626 | L | H | C | T | F | I | D | D | F | 4 | 3476 |
| 635 | T | P | Y | H | M | L | H | G | E | 4 | 3477 |
| 642 | G | E | V | H | C | G | T | N | V | 4 | 3478 |
| 651 | C | R | K | P | F | S | F | K | W | 4 | 3479 |
| 653 | K | P | F | S | F | K | W | W | N | 4 | 3480 |
| 33 | V | P | E | G | T | E | M | F | E | 3 | 3481 |
| 44 | G | T | P | G | V | D | I | Y | I | 3 | 3482 |
| 46 | P | G | V | D | I | Y | I | S | P | 3 | 3483 |
| 48 | V | D | I | Y | I | S | P | N | M | 3 | 3484 |
| 53 | S | P | N | M | E | R | G | R | E | 3 | 3485 |
| 80 | M | N | S | P | S | N | D | L | N | 3 | 3486 |
| 81 | N | S | P | S | N | D | L | N | D | 3 | 3487 |
| 112 | L | T | C | V | D | I | S | L | D | 3 | 3488 |
| 115 | V | D | I | S | L | D | C | D | L | 3 | 3489 |
| 135 | D | K | R | Q | W | V | W | G | P | 3 | 3490 |
| 141 | W | G | P | S | G | Y | G | G | I | 3 | 3491 |
| 152 | V | N | C | D | R | D | D | P | S | 3 | 3492 |
| 179 | D | M | S | V | M | V | L | R | T | 3 | 3493 |
| 182 | V | M | V | L | R | T | Q | G | P | 3 | 3494 |
| 195 | D | D | H | K | L | V | L | H | T | 3 | 3495 |
| 203 | T | S | S | Y | D | A | K | R | A | 3 | 3496 |
| 211 | A | Q | V | F | H | I | C | G | P | 3 | 3497 |
| 246 | E | E | R | F | F | V | E | G | L | 3 | 3498 |
| 273 | D | D | S | N | E | D | F | S | A | 3 | 3499 |
| 278 | D | F | S | A | S | P | I | F | T | 3 | 3500 |
| 291 | F | R | V | A | P | W | I | M | T | 3 | 3501 |
| 323 | V | A | E | L | A | R | K | A | G | 3 | 3502 |
| 330 | A | G | C | K | L | T | I | C | P | 3 | 3503 |
| 344 | N | D | R | W | I | Q | D | E | M | 3 | 3504 |
| 349 | Q | D | E | M | E | L | G | Y | V | 3 | 3505 |
| 387 | P | D | F | E | G | Y | T | R | E | 3 | 3506 |
| 417 | V | A | N | G | K | E | Y | P | L | 3 | 3507 |
| 418 | A | N | G | K | E | Y | P | L | G | 3 | 3508 |
| 434 | L | P | G | S | S | G | R | R | V | 3 | 3509 |
| 459 | V | E | L | F | V | D | W | L | A | 3 | 3510 |
| 473 | E | F | L | S | F | V | A | P | D | 3 | 3511 |
| 475 | L | S | F | V | P | A | P | D | G | 3 | 3512 |
| 481 | P | D | G | K | G | F | R | M | L | 3 | 3513 |
| 513 | L | F | Q | G | V | V | T | D | E | 3 | 3514 |
| 520 | D | E | V | K | T | I | S | I | N | 3 | 3515 |
| 521 | E | Q | V | K | T | I | S | I | N | 3 | 3516 |
| 533 | S | N | K | D | L | I | N | Y | N | 3 | 3517 |
| 542 | K | F | V | Q | S | C | I | D | W | 3 | 3518 |
| 545 | Q | S | C | I | D | W | N | R | E | 3 | 3519 |
| 584 | F | P | D | L | V | N | M | L | V | 3 | 3520 |
| 594 | G | K | H | L | G | I | P | K | P | 3 | 3521 |
| 600 | P | K | P | F | G | P | I | I | N | 3 | 3522 |
| 602 | P | F | G | P | I | I | N | G | C | 3 | 3523 |
| 621 | L | E | P | L | G | L | H | C | T | 3 | 3524 |
| 631 | I | D | D | F | T | P | Y | H | M | 3 | 3525 |
| 634 | F | T | P | Y | H | M | L | H | G | 3 | 3526 |
| 23 | V | E | T | L | V | D | I | Y | G | 2 | 3527 |
| 24 | E | T | L | V | D | I | Y | G | S | 2 | 3528 |
| 40 | F | E | V | Y | G | T | P | G | V | 2 | 3529 |
| 82 | S | P | S | N | D | L | N | D | S | 2 | 3530 |
| 98 | S | S | H | E | P | L | P | L | A | 2 | 3531 |
| 107 | Y | A | V | L | Y | L | T | C | V | 2 | 3532 |
| 110 | L | Y | L | T | C | V | D | I | S | 2 | 3533 |
| 159 | P | S | C | D | V | Q | D | N | C | 2 | 3534 |
| 169 | Q | H | V | H | C | L | Q | D | L | 2 | 3535 |
| 172 | H | C | L | Q | D | L | E | D | M | 2 | 3536 |
| 243 | H | G | D | E | E | R | F | F | V | 2 | 3537 |
| 247 | E | R | F | F | V | E | G | L | S | 2 | 3538 |
| 308 | V | Y | V | C | R | V | R | N | N | 2 | 3539 |
| 331 | G | C | K | L | T | I | C | P | Q | 2 | 3540 |
| 336 | I | C | P | Q | A | E | N | R | N | 2 | 3541 |
| 337 | C | P | Q | A | E | N | R | N | D | 2 | 3542 |
| 345 | D | R | W | I | Q | D | E | M | E | 2 | 3543 |
| 378 | D | F | P | Y | K | R | I | L | G | 2 | 3544 |
| 390 | G | Y | V | T | R | E | P | R | D | 2 | 3545 |
| 442 | V | T | Q | V | V | R | D | F | L | 2 | 3546 |
| 450 | L | H | A | Q | K | V | Q | P | P | 2 | 3547 |
| 463 | V | D | W | L | A | V | G | H | V | 2 | 3548 |
| 496 | C | F | K | L | F | Q | E | K | Q | 2 | 3549 |
| 499 | L | F | Q | E | K | Q | K | C | G | 2 | 3550 |
| 509 | G | R | A | L | L | F | Q | G | V | 2 | 3551 |
| 519 | D | D | E | Q | V | K | T | I | S | 2 | 3552 |
| 528 | I | N | Q | V | L | S | N | K | D | 2 | 3553 |
| 539 | N | Y | N | K | F | V | Q | S | C | 2 | 3554 |
| 572 | L | F | K | T | E | R | K | K | A | 2 | 3555 |
| 583 | F | F | P | D | L | V | N | M | L | 2 | 3556 |
| 603 | F | G | P | I | I | N | G | C | C | 2 | 3557 |
| 624 | L | G | L | H | C | T | F | I | D | 2 | 3558 |
| 640 | L | H | G | E | V | H | C | G | T | 2 | 3559 |
| 646 | C | G | T | N | V | C | R | K | P | 2 | 3560 |
| 648 | T | N | V | C | R | K | P | F | S | 2 | 3561 |
| 70 | F | D | A | T | L | E | I | I | V | 1 | 3562 |
| 90 | S | H | V | Q | I | S | Y | H | S | 1 | 3563 |
| 95 | S | Y | H | S | S | H | E | P | L | 1 | 3564 |
| 119 | L | D | C | D | L | N | C | E | G | 1 | 3565 |
| 130 | D | R | N | F | V | D | K | R | Q | 1 | 3566 |
| 155 | D | R | D | D | P | S | C | D | V | 1 | 3567 |
| 160 | S | C | D | V | Q | D | N | C | D | 1 | 3568 |
| 163 | V | Q | D | N | C | D | Q | H | V | 1 | 3569 |
| 167 | C | D | Q | H | V | H | C | L | Q | 1 | 3570 |
| 217 | C | G | P | E | D | V | C | E | A | 1 | 3571 |
| 231 | G | Q | D | K | V | S | Y | E | V | 1 | 3572 |
| 251 | V | E | G | L | S | F | P | D | A | 1 | 3573 |
| 261 | F | T | G | L | I | S | F | H | V | 1 | 3574 |
| 285 | F | T | D | T | V | V | F | R | V | 1 | 3575 |
| 293 | V | A | P | W | I | M | T | P | S | 1 | 3576 |
| 299 | T | P | S | T | L | P | P | L | E | 1 | 3577 |
| 315 | N | N | T | C | F | V | D | A | V | 1 | 3578 |
| 355 | G | Y | V | Q | A | P | H | K | T | 1 | 3579 |
| 367 | V | F | D | S | P | R | N | G | E | 1 | 3580 |
| 388 | D | F | G | Y | V | T | R | E | P | 1 | 3581 |
| 401 | V | S | G | L | D | S | E | G | N | 1 | 3582 |
| 414 | P | P | V | A | N | G | K | E | P | 1 | 3583 |
| 420 | G | K | E | Y | P | L | G | R | I | 1 | 3584 |
| 451 | H | A | Q | K | V | Q | P | P | V | 1 | 3585 |
| 514 | F | Q | G | V | V | D | D | E | Q | 1 | 3586 |
| 529 | N | Q | V | L | S | N | K | D | L | 1 | 3587 |
| 563 | E | C | D | I | I | D | I | P | G | 1 | 3588 |
| 617 | V | R | S | L | L | E | P | L | G | 1 | 3589 |
| 632 | D | D | F | T | P | Y | H | M | L | 1 | 3590 |
| 636 | P | Y | H | M | L | H | G | E | V | 1 | 3591 |
| 654 | P | F | S | F | K | W | W | N | M | 1 | 3592 |
| 655 | F | S | F | K | W | W | N | M | V | 1 | 3593 |

TABLE XXVI-continued

| Pos | 1 | 2 | 3 | 4 | 5 | 6 | 7 | 8 | 9 | score | SEQ. ID NO. |
|---|---|---|---|---|---|---|---|---|---|---|---|
| \multicolumn{11}{c}{184P1E2 v.2: HLA Peptide Scoring Results A3 9-mers SYFPEITHI} | |
| 7 | T | L | A | P | L | E | V | Y | V | 18 | 3594 |
| 6 | S | T | L | A | P | L | E | V | Y | 15 | 3595 |
| 9 | A | P | L | E | V | Y | V | C | R | 15 | 3596 |
| 1 | W | I | M | T | P | S | T | L | A | 9 | 3597 |
| 2 | I | M | T | P | S | T | L | A | P | 9 | 3598 |
| 5 | P | S | T | L | A | P | L | E | V | 5 | 3599 |
| 8 | L | A | P | L | E | V | Y | V | C | 5 | 3600 |
| 3 | M | T | P | S | T | L | A | P | L | 3 | 3601 |
| 4 | T | P | S | T | L | A | P | L | E | 3 | 3602 |
| \multicolumn{11}{c}{184P1E2 v.3: HLA Peptide Scoring Results A3 9-mers SYFPEITHI} | |
| 8 | P | V | P | D | G | K | G | F | R | 18 | 3603 |
| 3 | F | L | S | F | V | P | V | P | D | 16 | 3604 |
| 5 | S | F | V | P | V | P | D | G | K | 16 | 3605 |
| 6 | F | V | P | V | P | D | G | K | G | 11 | 3606 |
| 7 | V | P | V | P | D | G | K | G | F | 10 | 3607 |
| 2 | E | F | L | S | F | V | P | V | P | 6 | 3608 |
| 9 | V | P | D | G | K | G | F | R | M | 6 | 3609 |
| 1 | D | E | F | L | S | F | V | P | V | 5 | 3610 |

TABLE XXVII

| Pos | 1 | 2 | 3 | 4 | 5 | 6 | 7 | 8 | 9 | score | SEQ. ID NO. |
|---|---|---|---|---|---|---|---|---|---|---|---|
| \multicolumn{11}{c}{184P1E2 v.1: HLA Peptide Scoring Results A26 9-mers SYFPEITHI} | |
| 565 | D | I | I | D | I | P | Q | L | F | 30 | 3611 |
| 301 | S | T | L | P | P | L | E | V | Y | 26 | 3612 |
| 454 | K | V | Q | P | P | V | E | L | F | 26 | 3613 |
| 553 | E | V | L | K | R | E | L | G | L | 26 | 3614 |
| 22 | G | V | E | T | L | V | D | I | Y | 25 | 3615 |
| 28 | D | I | Y | G | S | V | P | E | G | 25 | 3616 |
| 72 | A | T | L | E | I | I | V | V | M | 25 | 3617 |
| 298 | M | T | P | S | T | L | P | P | L | 25 | 3618 |
| 441 | R | V | T | Q | V | V | R | D | F | 25 | 3619 |
| 32 | S | V | P | E | G | T | E | M | F | 24 | 3620 |
| 234 | K | V | S | Y | E | V | P | R | L | 24 | 3621 |
| 411 | E | V | S | P | P | V | V | A | N | 24 | 3622 |
| 582 | A | F | F | P | D | L | V | N | M | 24 | 3623 |
| 612 | C | L | E | E | K | V | R | S | L | 24 | 3624 |
| 616 | K | V | R | S | L | L | E | P | L | 24 | 3625 |
| 75 | E | I | I | V | V | M | N | S | P | 23 | 3626 |
| 186 | R | T | Q | G | P | A | A | L | F | 23 | 3627 |
| 221 | D | V | C | E | A | Y | R | H | V | 23 | 3628 |
| 283 | P | I | F | T | D | T | V | V | F | 23 | 3629 |
| 383 | R | I | L | G | P | D | F | G | Y | 23 | 3630 |
| 568 | D | I | P | Q | L | F | K | T | E | 23 | 3631 |
| 629 | T | F | I | D | D | F | T | P | Y | 23 | 3632 |
| 35 | E | G | T | E | M | F | E | V | Y | 22 | 3633 |
| 102 | P | L | P | L | A | Y | A | V | L | 22 | 3634 |
| 264 | L | I | S | F | H | V | T | L | L | 22 | 3635 |
| 458 | P | V | E | L | F | V | D | W | L | 22 | 3636 |
| 524 | K | T | I | S | I | N | Q | V | L | 22 | 3637 |
| 583 | F | F | P | D | L | V | N | M | L | 22 | 3638 |
| 649 | N | V | C | R | K | P | F | S | F | 22 | 3639 |
| 24 | E | T | L | V | D | I | Y | G | S | 21 | 3640 |
| 104 | P | L | A | Y | A | V | L | Y | L | 21 | 3641 |
| 229 | V | L | G | Q | D | K | V | S | Y | 21 | 3642 |
| 241 | R | L | H | G | D | E | E | R | F | 21 | 3643 |
| 271 | L | L | D | D | S | N | E | D | F | 21 | 3644 |
| 318 | C | F | V | D | V | A | V | E | L | 21 | 3645 |
| 415 | P | V | V | A | N | G | K | E | Y | 21 | 3646 |
| 489 | L | L | A | S | P | G | A | C | F | 21 | 3647 |
| 632 | D | D | F | T | P | Y | H | M | L | 21 | 3648 |
| 198 | K | L | V | L | H | T | S | S | Y | 20 | 3649 |
| 253 | G | L | S | F | P | D | A | G | F | 20 | 3650 |
| 263 | G | L | I | S | F | H | V | T | L | 20 | 3651 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 277 | E | D | F | S | A | S | P | I | F | 20 | 3652 |
| 605 | P | I | I | N | G | C | C | C | L | 20 | 3653 |
| 647 | G | T | N | V | C | R | K | P | F | 20 | 3654 |
| 246 | E | E | R | F | F | V | E | G | L | 19 | 3655 |
| 248 | R | F | F | V | E | G | L | S | F | 19 | 3656 |
| 473 | E | F | L | S | F | V | P | A | P | 19 | 3657 |
| 547 | C | I | D | W | N | R | E | V | L | 19 | 3658 |
| 576 | E | R | K | K | A | T | A | F | F | 19 | 3659 |
| 586 | D | L | V | N | M | L | V | L | G | 19 | 3660 |
| 622 | E | P | L | G | L | H | C | T | F | 19 | 3661 |
| 41 | E | V | Y | G | T | P | G | V | D | 18 | 3662 |
| 49 | D | I | Y | I | S | P | N | M | E | 18 | 3663 |
| 86 | D | L | N | D | S | H | V | Q | I | 18 | 3664 |
| 162 | D | V | Q | D | N | C | D | Q | H | 18 | 3665 |
| 238 | E | V | P | R | L | H | G | D | E | 18 | 3666 |
| 287 | D | T | V | V | F | R | V | A | P | 18 | 3667 |
| 292 | R | V | A | P | W | I | M | T | P | 18 | 3668 |
| 307 | E | V | Y | V | C | R | V | R | N | 18 | 3669 |
| 356 | Y | V | Q | A | P | H | K | T | L | 18 | 3670 |
| 429 | L | I | G | G | N | L | P | G | S | 18 | 3671 |
| 442 | V | T | Q | V | V | R | D | F | L | 18 | 3672 |
| 467 | A | V | G | H | V | D | E | F | L | 18 | 3673 |
| 470 | H | V | D | E | F | L | S | F | V | 18 | 3674 |
| 482 | D | G | K | G | F | R | M | L | L | 18 | 3675 |
| 51 | Y | I | S | P | N | M | E | R | G | 17 | 3676 |
| 111 | Y | L | T | C | V | D | I | S | L | 17 | 3677 |
| 176 | D | L | E | D | M | S | V | M | V | 17 | 3678 |
| 259 | A | G | F | T | G | L | I | S | F | 17 | 3679 |
| 371 | P | R | N | G | E | L | Q | D | F | 17 | 3680 |
| 460 | E | L | F | V | D | W | L | A | V | 17 | 3681 |
| 466 | L | A | V | G | H | V | D | E | F | 17 | 3682 |
| 527 | S | I | N | Q | V | L | S | N | K | 17 | 3683 |
| 6 | I | V | R | V | S | L | E | H | P | 16 | 3684 |
| 43 | Y | G | T | P | G | V | D | I | Y | 16 | 3685 |
| 47 | G | V | D | I | Y | I | S | P | N | 16 | 3686 |
| 64 | D | T | R | W | R | F | D | A | A | 16 | 3687 |
| 91 | H | V | Q | I | S | Y | H | S | S | 16 | 3688 |
| 114 | C | V | D | I | S | L | D | C | D | 16 | 3689 |
| 116 | D | I | S | L | D | C | D | L | N | 16 | 3690 |
| 193 | L | F | D | D | H | K | L | V | L | 16 | 3691 |
| 285 | F | T | D | T | V | V | F | R | V | 16 | 3692 |
| 325 | E | L | A | R | K | A | G | C | K | 16 | 3693 |
| 362 | K | T | L | P | V | V | F | D | S | 16 | 3694 |
| 375 | E | L | Q | D | F | P | Y | K | R | 16 | 3695 |
| 396 | P | R | D | R | S | V | S | G | L | 16 | 3696 |
| 399 | R | S | V | S | G | L | D | S | F | 16 | 3697 |
| 445 | V | V | R | D | F | L | H | A | Q | 16 | 3698 |
| 469 | G | H | V | D | E | F | L | S | F | 16 | 3699 |
| 512 | L | L | F | Q | G | V | V | D | D | 16 | 3700 |
| 532 | L | S | N | K | D | L | I | N | Y | 16 | 3701 |
| 536 | D | L | I | N | Y | N | K | F | V | 16 | 3702 |
| 564 | C | D | I | I | D | I | P | Q | L | 16 | 3703 |
| 587 | L | V | N | M | L | V | L | G | K | 16 | 3704 |
| 598 | G | I | P | K | P | F | G | P | I | 16 | 3705 |
| 634 | F | T | P | Y | H | M | L | H | G | 16 | 3706 |
| 643 | E | V | H | C | G | T | N | V | C | 16 | 3707 |
| 654 | P | F | S | F | K | W | W | N | M | 16 | 3708 |
| 112 | L | T | C | V | D | I | S | L | D | 15 | 3709 |
| 122 | D | L | N | C | E | G | R | Q | D | 15 | 3710 |
| 175 | Q | D | L | E | D | M | S | V | M | 15 | 3711 |
| 177 | L | E | D | M | S | V | M | V | L | 15 | 3712 |
| 288 | T | V | V | F | R | V | A | P | W | 15 | 3713 |
| 322 | A | V | A | E | L | A | R | K | A | 15 | 3714 |
| 347 | W | I | Q | D | E | M | E | L | G | 15 | 3715 |
| 353 | E | L | G | Y | V | Q | A | P | H | 15 | 3716 |
| 366 | V | V | F | D | S | P | R | N | G | 15 | 3717 |
| 402 | S | G | L | D | S | F | G | N | L | 15 | 3718 |
| 444 | Q | V | V | R | D | F | L | H | A | 15 | 3719 |
| 535 | K | D | L | I | N | Y | N | K | F | 15 | 3720 |
| 543 | F | V | Q | S | C | I | D | W | N | 15 | 3721 |
| 633 | D | F | T | P | Y | H | M | L | H | 15 | 3722 |
| 25 | T | L | V | D | I | Y | G | S | V | 14 | 3723 |
| 38 | E | M | F | E | V | Y | G | T | P | 14 | 3724 |
| 73 | T | L | E | I | I | V | V | M | N | 14 | 3725 |
| 99 | S | H | E | P | L | P | L | A | Y | 14 | 3726 |
| 166 | N | C | D | Q | H | V | H | C | L | 14 | 3727 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 256 | F | P | D | A | G | F | T | G | L | 14 | 3728 |
| 260 | G | F | T | G | L | I | S | F | H | 14 | 3729 |
| 274 | D | S | N | E | D | F | S | A | S | 14 | 3730 |
| 290 | V | F | R | V | A | P | W | I | M | 14 | 3731 |
| 334 | L | T | I | C | P | Q | A | E | N | 14 | 3732 |
| 335 | T | I | C | P | Q | A | E | N | R | 14 | 3733 |
| 348 | I | Q | D | E | M | E | L | G | Y | 14 | 3734 |
| 363 | T | L | P | V | V | F | D | S | P | 14 | 3735 |
| 378 | D | F | P | Y | K | R | I | L | G | 14 | 3736 |
| 384 | I | L | G | P | D | F | G | Y | V | 14 | 3737 |
| 400 | S | V | S | G | L | D | S | F | G | 14 | 3738 |
| 405 | D | S | F | G | N | L | E | V | S | 14 | 3739 |
| 462 | F | V | D | W | L | A | V | G | H | 14 | 3740 |
| 472 | D | E | F | L | S | F | V | P | A | 14 | 3741 |
| 478 | V | P | A | P | D | G | K | G | F | 14 | 3742 |
| 481 | P | D | G | K | G | F | R | M | L | 14 | 3743 |
| 492 | S | P | G | A | C | F | K | L | F | 14 | 3744 |
| 517 | V | V | D | D | E | Q | V | K | T | 14 | 3745 |
| 558 | E | L | G | L | A | E | C | D | I | 14 | 3746 |
| 591 | L | V | L | G | K | H | L | G | I | 14 | 3747 |
| 619 | S | L | L | E | P | L | G | L | H | 14 | 3748 |
| 626 | L | H | C | T | F | I | D | D | F | 14 | 3749 |
| 639 | M | L | H | G | E | V | H | C | G | 14 | 3750 |
| 19 | C | V | A | G | V | E | T | L | V | 13 | 3751 |
| 44 | G | T | P | G | V | D | I | Y | I | 13 | 3752 |
| 78 | V | V | M | N | S | P | S | N | D | 13 | 3753 |
| 118 | S | L | D | C | D | L | N | C | E | 13 | 3754 |
| 169 | Q | H | V | H | C | L | Q | D | L | 13 | 3755 |
| 172 | H | C | L | Q | D | L | E | D | M | 13 | 3756 |
| 195 | D | D | H | K | L | V | L | H | T | 13 | 3757 |
| 202 | H | T | S | S | Y | D | A | K | R | 13 | 3758 |
| 206 | Y | D | A | K | R | A | Q | V | F | 13 | 3759 |
| 228 | H | V | L | G | Q | D | K | V | S | 13 | 3760 |
| 249 | F | F | V | E | G | L | S | F | P | 13 | 3761 |
| 250 | F | V | E | G | L | S | F | P | D | 13 | 3762 |
| 278 | D | F | S | A | S | P | I | F | T | 13 | 3763 |
| 289 | V | V | F | R | V | A | P | W | I | 13 | 3764 |
| 302 | T | L | P | P | L | E | V | Y | V | 13 | 3765 |
| 305 | P | L | E | V | Y | V | C | R | V | 13 | 3766 |
| 346 | R | W | I | Q | D | E | M | E | L | 13 | 3767 |
| 360 | P | H | K | T | L | P | V | V | F | 13 | 3768 |
| 388 | D | F | G | Y | V | T | R | E | P | 13 | 3769 |
| 392 | V | T | R | E | P | R | D | R | S | 13 | 3770 |
| 424 | P | L | G | R | I | L | I | G | G | 13 | 3771 |
| 433 | N | L | P | G | S | S | G | R | R | 13 | 3772 |
| 480 | A | P | D | G | K | G | F | R | M | 13 | 3773 |
| 485 | G | F | R | M | L | L | A | S | F | 13 | 3774 |
| 498 | K | L | F | Q | E | K | Q | K | C | 13 | 3775 |
| 554 | V | L | K | R | E | L | G | L | A | 13 | 3776 |
| 575 | T | E | R | K | K | A | T | A | F | 13 | 3777 |
| 579 | K | A | T | A | F | F | P | D | L | 13 | 3778 |
| 592 | V | L | G | K | H | L | G | I | P | 13 | 3779 |
| 602 | P | F | G | P | I | I | N | G | C | 13 | 3780 |
| 630 | F | I | D | D | F | T | P | Y | H | 13 | 3781 |
| 2 | S | L | Q | R | I | V | R | V | S | 12 | 3782 |
| 14 | P | T | S | A | V | C | V | A | G | 12 | 3783 |
| 17 | A | V | C | V | A | G | V | E | T | 12 | 3784 |
| 18 | V | C | V | A | G | V | E | T | L | 12 | 3785 |
| 26 | L | V | D | I | Y | G | S | V | P | 12 | 3786 |
| 48 | V | D | I | Y | I | S | P | N | M | 12 | 3787 |
| 62 | R | A | D | T | R | R | W | R | F | 12 | 3788 |
| 77 | I | V | V | M | N | S | P | S | N | 12 | 3789 |
| 89 | D | S | H | V | Q | I | S | Y | H | 12 | 3790 |
| 93 | Q | I | S | Y | H | S | S | H | E | 12 | 3791 |
| 115 | V | D | I | S | L | D | C | D | L | 12 | 3792 |
| 125 | C | E | G | R | Q | D | R | N | F | 12 | 3793 |
| 133 | F | V | D | K | R | Q | W | V | W | 12 | 3794 |
| 135 | D | K | R | Q | W | V | W | G | P | 12 | 3795 |
| 138 | Q | W | V | W | G | P | S | G | Y | 12 | 3796 |
| 139 | W | V | W | G | P | S | G | Y | G | 12 | 3797 |
| 178 | E | D | M | S | V | M | V | L | R | 12 | 3798 |
| 181 | S | V | M | V | L | R | T | Q | G | 12 | 3799 |
| 212 | Q | V | F | H | I | C | G | P | E | 12 | 3800 |
| 215 | H | I | C | G | P | E | D | V | C | 12 | 3801 |
| 218 | G | P | E | D | V | C | E | A | Y | 12 | 3802 |
| 245 | D | E | E | R | F | F | V | E | G | 12 | 3803 |
| 268 | H | V | T | L | L | D | D | S | N | 12 | 3804 |
| 269 | V | T | L | L | D | D | S | N | E | 12 | 3805 |
| 284 | I | F | T | D | T | V | V | F | R | 12 | 3806 |
| 321 | D | A | V | A | E | L | A | R | K | 12 | 3807 |
| 351 | E | M | E | L | G | Y | V | Q | A | 12 | 3808 |
| 365 | P | V | V | F | D | S | P | R | N | 12 | 3809 |
| 377 | Q | D | F | P | Y | K | R | I | L | 12 | 3810 |
| 381 | Y | K | R | I | L | G | P | D | F | 12 | 3811 |
| 428 | I | L | I | G | G | N | L | P | G | 12 | 3812 |
| 448 | D | F | L | H | A | Q | K | V | Q | 12 | 3813 |
| 461 | L | F | V | D | W | L | A | V | G | 12 | 3814 |
| 477 | F | V | P | A | P | D | G | K | G | 12 | 3815 |
| 491 | A | S | P | G | A | C | F | K | L | 12 | 3816 |
| 506 | C | G | H | G | R | A | L | L | F | 12 | 3817 |
| 513 | L | F | Q | G | V | V | D | D | E | 12 | 3818 |
| 516 | G | V | V | D | D | E | Q | V | K | 12 | 3819 |
| 521 | E | Q | V | K | T | I | S | I | N | 12 | 3820 |
| 522 | Q | V | K | T | I | S | I | N | Q | 12 | 3821 |
| 571 | Q | L | F | K | T | E | R | K | K | 12 | 3822 |
| 574 | K | T | E | R | K | K | A | T | A | 12 | 3823 |
| 585 | P | D | L | V | N | M | L | V | L | 12 | 3824 |
| 595 | K | H | L | G | I | P | K | P | F | 12 | 3825 |
| 606 | I | I | N | G | C | C | C | L | E | 12 | 3826 |
| 615 | E | K | V | R | S | L | L | E | P | 12 | 3827 |
| 620 | L | L | E | P | L | G | L | H | C | 12 | 3828 |
| 625 | G | L | H | C | T | F | I | D | D | 12 | 3829 |
| 628 | C | T | F | I | D | D | F | T | P | 12 | 3830 |
| 5 | R | I | V | R | V | S | L | E | H | 11 | 3831 |
| 8 | R | V | S | L | E | H | P | T | S | 11 | 3832 |
| 31 | G | S | V | P | E | G | T | E | M | 11 | 3833 |
| 36 | G | T | E | M | F | E | V | Y | G | 11 | 3834 |
| 69 | R | F | D | A | T | L | E | I | I | 11 | 3835 |
| 76 | I | I | V | V | M | N | S | P | S | 11 | 3836 |
| 88 | N | D | S | H | V | Q | I | S | Y | 11 | 3837 |
| 103 | L | P | L | A | Y | A | V | L | Y | 11 | 3838 |
| 108 | A | V | L | Y | L | T | C | V | D | 11 | 3839 |
| 158 | D | P | S | C | D | V | Q | D | N | 11 | 3840 |
| 170 | H | V | H | C | L | Q | D | L | E | 11 | 3841 |
| 173 | C | L | Q | D | L | E | D | M | S | 11 | 3842 |
| 179 | D | M | S | V | M | V | L | R | T | 11 | 3843 |
| 184 | V | L | R | T | Q | G | P | A | A | 11 | 3844 |
| 185 | L | R | T | Q | G | P | A | A | L | 11 | 3845 |
| 192 | A | L | F | D | D | H | K | L | V | 11 | 3846 |
| 196 | D | H | K | L | V | L | H | T | S | 11 | 3847 |
| 199 | L | V | L | H | T | S | S | Y | D | 11 | 3848 |
| 224 | E | A | Y | R | H | V | L | G | Q | 11 | 3849 |
| 242 | L | H | G | D | E | E | R | F | F | 11 | 3850 |
| 261 | F | T | G | L | I | S | F | H | V | 11 | 3851 |
| 295 | P | W | I | M | T | P | S | T | L | 11 | 3852 |
| 309 | Y | V | C | R | V | R | N | N | T | 11 | 3853 |
| 316 | N | T | C | F | V | D | A | V | A | 11 | 3854 |
| 319 | F | V | D | A | V | A | E | L | A | 11 | 3855 |
| 368 | F | D | S | P | R | N | G | E | L | 11 | 3856 |
| 373 | N | G | E | L | Q | D | F | P | Y | 11 | 3857 |
| 416 | V | V | A | N | G | K | E | Y | P | 11 | 3858 |
| 417 | V | A | N | G | K | E | Y | P | L | 11 | 3859 |
| 421 | K | E | Y | P | L | G | R | I | L | 11 | 3860 |
| 426 | G | R | I | L | I | G | G | N | L | 11 | 3861 |
| 449 | F | L | H | A | Q | K | V | Q | P | 11 | 3862 |
| 453 | Q | K | V | Q | P | P | V | E | L | 11 | 3863 |
| 504 | Q | K | C | G | H | G | R | A | L | 11 | 3864 |
| 525 | T | I | S | I | N | Q | V | L | S | 11 | 3865 |
| 530 | Q | V | L | S | N | K | D | L | I | 11 | 3866 |
| 549 | D | W | N | R | E | V | L | K | R | 11 | 3867 |
| 560 | G | L | A | E | C | D | I | I | D | 11 | 3868 |
| 566 | I | I | D | I | P | Q | L | F | K | 11 | 3869 |
| 580 | A | T | A | F | F | P | D | L | V | 11 | 3870 |
| 3 | L | Q | R | I | V | R | V | S | L | 10 | 3871 |
| 10 | S | L | E | H | P | T | S | A | V | 10 | 3872 |
| 71 | D | A | T | L | E | I | I | V | V | 10 | 3873 |
| 95 | S | Y | H | S | S | H | E | P | L | 10 | 3874 |
| 101 | E | P | L | P | L | A | Y | A | V | 10 | 3875 |
| 142 | G | P | S | G | Y | G | G | I | L | 10 | 3876 |
| 148 | G | I | L | L | V | N | C | D | R | 10 | 3877 |
| 151 | L | V | N | C | D | R | D | D | P | 10 | 3878 |
| 157 | D | D | P | S | C | D | V | Q | D | 10 | 3879 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 165 | D | N | C | D | Q | H | V | H | C | 10 | 3880 |
| 183 | M | V | L | R | T | Q | G | P | A | 10 | 3881 |
| 266 | S | F | H | V | T | L | L | D | D | 10 | 3882 |
| 270 | T | L | L | D | D | S | N | E | D | 10 | 3883 |
| 296 | W | I | M | T | P | S | T | L | P | 10 | 3884 |
| 311 | C | R | V | R | N | N | T | C | F | 10 | 3885 |
| 312 | R | V | R | N | N | T | C | F | V | 10 | 3886 |
| 326 | L | A | R | K | A | G | C | K | L | 10 | 3887 |
| 333 | K | L | T | I | C | P | Q | A | E | 10 | 3888 |
| 391 | Y | V | T | R | E | P | R | D | R | 10 | 3889 |
| 403 | G | L | D | S | F | G | N | L | E | 10 | 3890 |
| 409 | N | L | E | V | S | P | P | V | V | 10 | 3891 |
| 427 | R | I | L | I | G | G | N | L | P | 10 | 3892 |
| 465 | W | L | A | V | G | H | V | D | E | 10 | 3893 |
| 488 | M | L | L | A | S | P | G | A | C | 10 | 3894 |
| 495 | A | C | F | K | L | F | Q | E | K | 10 | 3895 |
| 511 | A | L | L | F | Q | G | V | V | D | 10 | 3896 |
| 537 | L | I | N | Y | N | K | F | V | Q | 10 | 3897 |
| 551 | N | R | E | V | L | K | R | E | L | 10 | 3898 |
| 567 | I | D | I | P | Q | L | F | K | T | 10 | 3899 |
| 589 | N | M | L | V | L | G | K | H | L | 10 | 3900 |
| 613 | L | E | E | K | V | R | S | L | L | 10 | 3901 |
| 631 | I | D | D | F | T | P | Y | H | M | 10 | 3902 |
| 12 | E | H | P | T | S | A | V | C | V | 9 | 3903 |
| 66 | R | R | W | R | F | D | A | T | L | 9 | 3904 |
| 79 | V | M | N | S | P | S | N | D | L | 9 | 3905 |
| 109 | V | L | Y | L | T | C | V | D | I | 9 | 3906 |
| 132 | N | F | V | D | K | R | Q | W | V | 9 | 3907 |
| 149 | I | L | L | V | N | C | D | R | D | 9 | 3908 |
| 191 | A | A | L | F | D | D | H | K | L | 9 | 3909 |
| 200 | V | L | H | T | S | S | Y | D | A | 9 | 3910 |
| 344 | N | D | R | W | I | Q | D | E | M | 9 | 3911 |
| 350 | D | E | M | E | L | G | Y | V | Q | 9 | 3912 |
| 367 | V | F | D | S | P | R | N | G | E | 9 | 3913 |
| 387 | P | D | F | G | Y | V | T | R | E | 9 | 3914 |
| 395 | E | P | R | D | R | S | V | S | G | 9 | 3915 |
| 406 | S | F | G | N | L | E | V | S | P | 9 | 3916 |
| 412 | V | S | P | P | V | V | A | N | G | 9 | 3917 |
| 474 | F | L | S | F | V | P | A | P | D | 9 | 3918 |
| 476 | S | F | V | P | A | P | D | G | K | 9 | 3919 |
| 499 | L | F | Q | E | K | Q | K | C | G | 9 | 3920 |
| 505 | K | C | G | H | G | R | A | L | L | 9 | 3921 |
| 529 | N | Q | V | L | S | N | K | D | L | 9 | 3922 |
| 531 | V | L | S | N | K | D | L | I | N | 9 | 3923 |
| 596 | H | L | G | I | P | K | P | F | G | 9 | 3924 |
| 601 | K | P | F | G | P | I | I | N | G | 9 | 3925 |
| 618 | R | S | L | L | E | P | L | G | L | 9 | 3926 |
| 61 | E | R | A | D | T | R | R | W | R | 8 | 3927 |
| 74 | L | E | I | I | V | V | M | N | S | 8 | 3928 |
| 97 | H | S | S | H | E | P | L | P | L | 8 | 3929 |
| 120 | D | C | D | L | N | C | E | G | R | 8 | 3930 |
| 143 | P | S | G | Y | G | G | I | L | L | 8 | 3931 |
| 150 | L | L | V | N | C | D | R | D | D | 8 | 3932 |
| 155 | D | R | D | D | P | S | C | D | V | 8 | 3933 |
| 207 | D | A | K | R | A | Q | V | F | H | 8 | 3934 |
| 213 | V | F | H | I | C | G | P | E | D | 8 | 3935 |
| 217 | C | G | P | E | D | V | C | E | A | 8 | 3936 |
| 222 | V | C | E | A | Y | R | H | V | L | 8 | 3937 |
| 233 | D | K | V | S | Y | E | V | P | R | 8 | 3938 |
| 247 | E | R | F | F | V | E | G | L | S | 8 | 3939 |
| 252 | E | G | L | S | F | P | D | A | G | 8 | 3940 |
| 255 | S | F | P | D | A | G | F | T | G | 8 | 3941 |
| 345 | D | R | W | I | Q | D | E | M | E | 8 | 3942 |
| 352 | M | E | L | G | Y | V | Q | A | P | 8 | 3943 |
| 450 | L | H | A | Q | K | V | Q | P | P | 8 | 3944 |
| 457 | P | P | V | E | L | F | V | D | M | 8 | 3945 |
| 496 | C | F | K | L | F | Q | E | K | Q | 8 | 3946 |
| 502 | E | K | Q | K | C | G | H | G | R | 8 | 3947 |
| 509 | G | R | A | L | L | F | Q | G | V | 8 | 3948 |
| 518 | V | D | D | E | Q | V | K | T | I | 8 | 3949 |
| 520 | D | E | Q | V | K | T | I | S | I | 8 | 3950 |
| 526 | I | S | I | N | Q | V | L | S | N | 8 | 3951 |
| 542 | K | F | V | Q | S | C | I | D | W | 8 | 3952 |
| 572 | L | F | K | T | E | R | K | K | A | 8 | 3953 |
| 590 | M | L | V | L | G | K | H | L | G | 8 | 3954 |
| 623 | P | L | G | L | H | C | T | F | I | 8 | 3955 |
| 656 | S | F | K | W | W | N | M | V | P | 8 | 3956 |
| 1 | M | S | L | Q | R | I | V | R | V | 7 | 3957 |
| 4 | Q | R | I | V | R | V | S | L | E | 7 | 3958 |
| 15 | T | S | A | V | C | V | A | G | V | 7 | 3959 |
| 21 | A | G | V | E | T | L | V | D | I | 7 | 3960 |
| 57 | E | R | G | R | E | R | A | D | T | 7 | 3961 |
| 87 | L | N | D | S | H | V | Q | I | S | 7 | 3962 |
| 98 | S | S | H | E | P | L | P | L | A | 7 | 3963 |
| 126 | E | G | R | Q | D | R | N | F | V | 7 | 3964 |
| 130 | D | R | N | F | V | D | K | R | Q | 7 | 3965 |
| 141 | W | G | P | S | G | Y | G | G | I | 7 | 3966 |
| 146 | Y | G | G | I | L | L | V | N | C | 7 | 3967 |
| 147 | G | G | I | L | L | V | N | C | D | 7 | 3968 |
| 168 | D | Q | H | V | H | C | L | Q | D | 7 | 3969 |
| 194 | F | D | D | H | K | L | V | L | H | 7 | 3970 |
| 201 | L | H | T | S | S | Y | D | A | K | 7 | 3971 |
| 220 | E | D | V | C | E | A | Y | R | H | 7 | 3972 |
| 230 | L | G | Q | D | K | V | S | Y | E | 7 | 3973 |
| 237 | Y | E | V | P | R | L | H | G | D | 7 | 3974 |
| 273 | D | D | S | N | E | D | F | S | A | 7 | 3975 |
| 304 | P | P | L | E | V | Y | V | C | R | 7 | 3976 |
| 369 | D | S | P | R | N | G | E | L | Q | 7 | 3977 |
| 398 | D | R | S | V | S | G | L | D | S | 7 | 3978 |
| 422 | E | Y | P | L | G | R | I | L | I | 7 | 3979 |
| 440 | R | R | V | T | Q | V | V | R | D | 7 | 3980 |
| 484 | K | G | F | R | M | L | L | A | S | 7 | 3981 |
| 519 | D | D | E | Q | V | K | T | I | S | 7 | 3982 |
| 533 | S | N | K | D | L | I | N | Y | N | 7 | 3983 |
| 538 | I | N | Y | N | K | F | V | Q | S | 7 | 3984 |
| 539 | N | Y | N | K | F | V | Q | S | C | 7 | 3985 |
| 550 | W | N | R | E | V | L | K | R | E | 7 | 3986 |
| 563 | E | C | D | I | I | D | I | P | Q | 7 | 3987 |
| 614 | E | E | K | V | R | S | L | L | E | 7 | 3988 |
| 39 | M | F | E | V | Y | G | T | P | G | 6 | 3989 |
| 46 | P | G | V | D | I | Y | I | S | P | 6 | 3990 |
| 100 | H | E | P | L | P | L | A | Y | A | 6 | 3991 |
| 106 | A | Y | A | V | L | Y | L | T | C | 6 | 3992 |
| 128 | R | Q | D | R | N | F | V | D | K | 6 | 3993 |
| 144 | S | G | Y | G | G | I | L | L | V | 6 | 3994 |
| 145 | G | Y | G | G | I | L | L | V | N | 6 | 3995 |
| 189 | G | P | A | A | L | F | D | D | H | 6 | 3996 |
| 208 | A | K | R | A | Q | V | F | H | I | 6 | 3997 |
| 209 | K | R | A | Q | V | F | H | I | C | 6 | 3998 |
| 232 | Q | D | K | V | S | Y | E | V | P | 6 | 3999 |
| 244 | G | D | E | E | R | F | F | V | E | 6 | 4000 |
| 251 | V | E | G | L | S | F | P | D | A | 6 | 4001 |
| 258 | D | A | G | F | T | G | L | I | S | 6 | 4002 |
| 279 | F | S | A | S | P | I | F | T | D | 6 | 4003 |
| 280 | S | A | S | P | I | F | T | D | T | 6 | 4004 |
| 341 | E | N | R | N | D | R | W | I | Q | 6 | 4005 |
| 343 | R | N | D | R | W | I | Q | D | E | 6 | 4006 |
| 359 | A | P | H | K | T | L | P | V | V | 6 | 4007 |
| 374 | G | E | L | Q | D | F | P | Y | K | 6 | 4008 |
| 376 | L | Q | D | F | P | Y | K | R | I | 6 | 4009 |
| 379 | F | P | Y | K | R | I | L | G | P | 6 | 4010 |
| 386 | G | P | D | F | G | Y | V | T | R | 6 | 4011 |
| 418 | A | N | G | K | E | Y | P | L | G | 6 | 4012 |
| 423 | Y | P | L | G | R | I | L | I | G | 6 | 4013 |
| 425 | L | G | R | I | L | I | G | G | N | 6 | 4014 |
| 464 | D | W | L | A | V | G | H | V | D | 6 | 4015 |
| 494 | G | A | C | F | K | L | F | Q | E | 6 | 4016 |
| 508 | H | G | R | A | L | L | F | Q | G | 6 | 4017 |
| 523 | V | K | T | I | S | I | N | Q | V | 6 | 4018 |
| 556 | K | R | E | L | G | L | A | E | C | 6 | 4019 |
| 594 | G | K | H | L | G | I | P | K | P | 6 | 4020 |
| 597 | L | G | I | P | K | P | F | G | P | 6 | 4021 |
| 650 | V | C | R | K | P | F | S | F | K | 6 | 4022 |
| 652 | R | K | P | F | S | F | K | W | W | 6 | 4023 |
| 13 | H | P | T | S | A | V | C | V | A | 5 | 4024 |
| 34 | P | E | G | T | E | M | F | E | V | 5 | 4025 |
| 37 | T | E | M | F | E | V | Y | G | T | 5 | 4026 |
| 50 | I | Y | I | S | P | Y | N | M | E | 5 | 4027 |
| 65 | T | R | R | W | R | F | D | A | T | 5 | 4028 |
| 92 | V | Q | I | S | Y | H | S | S | H | 5 | 4029 |
| 129 | Q | D | R | N | F | V | D | K | R | 5 | 4030 |
| 188 | Q | G | P | A | A | L | F | D | D | 5 | 4031 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 211 | A | Q | V | F | H | I | C | G | P | 5 | 4032 |
| 225 | A | Y | R | H | V | L | G | Q | D | 5 | 4033 |
| 262 | T | G | L | I | S | F | H | V | T | 5 | 4034 |
| 267 | F | H | V | T | L | L | D | D | S | 5 | 4035 |
| 293 | V | A | P | W | I | M | T | P | S | 5 | 4036 |
| 303 | L | P | P | L | E | V | Y | V | C | 5 | 4037 |
| 308 | V | Y | V | C | R | V | R | N | N | 5 | 4038 |
| 314 | R | N | N | T | C | F | V | D | A | 5 | 4039 |
| 315 | N | N | T | C | F | V | D | A | V | 5 | 4040 |
| 329 | K | A | G | C | K | L | T | I | C | 5 | 4041 |
| 331 | G | C | K | L | T | I | C | P | Q | 5 | 4042 |
| 361 | H | K | T | L | P | V | V | F | D | 5 | 4043 |
| 380 | P | Y | K | R | I | L | G | P | D | 5 | 4044 |
| 407 | F | G | N | L | E | V | S | P | P | 5 | 4045 |
| 420 | G | K | E | Y | P | L | G | R | I | 5 | 4046 |
| 437 | S | S | G | R | R | V | T | Q | V | 5 | 4047 |
| 456 | Q | P | P | V | E | L | F | V | D | 5 | 4048 |
| 463 | V | D | W | L | A | V | G | H | V | 5 | 4049 |
| 562 | A | E | C | D | I | I | D | I | P | 5 | 4050 |
| 578 | K | K | A | T | A | F | F | P | D | 5 | 4051 |
| 588 | V | N | M | L | V | L | G | K | H | 5 | 4052 |
| 608 | N | G | C | C | C | L | E | E | K | 5 | 4053 |
| 621 | L | E | P | L | G | L | H | C | T | 5 | 4054 |
| 635 | T | P | Y | H | M | L | H | G | E | 5 | 4055 |
| 645 | H | C | G | T | N | V | C | R | K | 5 | 4056 |
| 45 | T | P | G | V | D | I | Y | I | S | 4 | 4057 |
| 68 | W | R | F | D | A | T | L | E | I | 4 | 4058 |
| 82 | S | P | S | N | D | L | N | D | S | 4 | 4059 |
| 105 | L | A | Y | A | V | L | Y | L | T | 4 | 4060 |
| 107 | Y | A | V | L | Y | L | T | C | V | 4 | 4061 |
| 110 | L | Y | L | T | C | V | D | I | S | 4 | 4062 |
| 140 | V | W | G | P | S | G | Y | G | G | 4 | 4063 |
| 156 | R | D | D | P | S | C | D | V | Q | 4 | 4064 |
| 180 | M | S | V | M | V | L | R | T | Q | 4 | 4065 |
| 205 | S | Y | D | A | K | R | A | Q | V | 4 | 4066 |
| 254 | L | S | F | P | D | A | G | F | T | 4 | 4067 |
| 286 | T | D | T | V | V | F | R | V | A | 4 | 4068 |
| 317 | T | C | F | V | D | A | V | A | E | 4 | 4069 |
| 349 | Q | D | E | M | E | L | G | Y | V | 4 | 4070 |
| 419 | N | G | K | E | Y | P | L | G | R | 4 | 4071 |
| 432 | G | N | L | P | G | S | S | G | R | 4 | 4072 |
| 446 | V | R | D | F | L | H | A | Q | K | 4 | 4073 |
| 447 | R | D | F | L | H | A | Q | K | V | 4 | 4074 |
| 483 | G | K | G | F | R | M | L | L | A | 4 | 4075 |
| 501 | Q | E | K | Q | K | C | G | H | G | 4 | 4076 |
| 507 | G | H | V | L | G | R | A | L | L | F | Q | 4 | 4077 |
| 546 | S | C | I | D | W | N | R | E | V | 4 | 4078 |
| 555 | L | K | R | E | L | G | L | A | E | 4 | 4079 |
| 561 | L | A | E | C | D | I | I | D | I | 4 | 4080 |
| 599 | I | P | K | P | F | G | P | I | I | 4 | 4081 |
| 611 | C | C | L | E | E | K | V | R | S | 4 | 4082 |
| 651 | C | R | K | P | F | S | F | K | W | 4 | 4083 |
| 655 | F | S | F | K | W | W | N | M | V | 4 | 4084 |
| 9 | V | S | L | E | H | P | T | S | A | 3 | 4085 |
| 11 | L | E | H | P | T | S | A | V | C | 3 | 4086 |
| 27 | V | D | I | Y | G | S | V | P | E | 3 | 4087 |
| 33 | V | P | E | G | T | E | M | F | E | 3 | 4088 |
| 54 | P | N | M | E | R | G | R | E | R | 3 | 4089 |
| 56 | M | E | R | G | R | E | R | A | D | 3 | 4090 |
| 80 | M | N | S | P | S | N | D | L | N | 3 | 4091 |
| 81 | N | S | P | S | N | D | L | N | D | 3 | 4092 |
| 83 | P | S | N | D | L | N | D | S | H | 3 | 4093 |
| 84 | S | N | D | L | N | D | S | H | V | 3 | 4094 |
| 119 | L | D | C | D | L | N | C | E | G | 3 | 4095 |
| 123 | L | N | C | E | G | R | Q | D | R | 3 | 4096 |
| 124 | N | C | E | G | R | Q | D | R | N | 3 | 4097 |
| 131 | R | N | F | V | D | K | R | Q | W | 3 | 4098 |
| 134 | V | D | K | R | Q | W | V | W | G | 3 | 4099 |
| 153 | N | C | D | R | D | D | P | S | C | 3 | 4100 |
| 163 | V | Q | D | N | C | D | Q | H | V | 3 | 4101 |
| 174 | L | Q | D | D | L | E | D | M | S | V | 3 | 4102 |
| 216 | I | C | G | P | E | D | V | C | E | 3 | 4103 |
| 231 | G | Q | D | K | V | S | Y | E | V | 3 | 4104 |
| 243 | H | G | D | E | E | R | F | F | V | 3 | 4105 |
| 257 | P | D | A | G | F | T | G | L | I | 3 | 4106 |
| 275 | S | N | E | D | F | S | A | S | P | 3 | 4107 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 276 | N | E | D | F | S | A | S | P | I | 3 | 4108 |
| 297 | I | M | T | P | S | T | L | P | P | 3 | 4109 |
| 328 | R | K | A | G | C | K | L | T | I | 3 | 4110 |
| 336 | I | C | P | Q | A | E | N | R | N | 3 | 4111 |
| 338 | P | Q | A | E | N | R | N | D | R | 3 | 4112 |
| 354 | L | G | Y | V | Q | A | P | H | K | 3 | 4113 |
| 357 | V | Q | A | P | H | K | T | L | P | 3 | 4114 |
| 372 | R | N | G | E | L | Q | D | F | P | 3 | 4115 |
| 393 | T | R | E | P | R | D | R | S | V | 3 | 4116 |
| 408 | G | N | L | E | V | S | P | P | V | 3 | 4117 |
| 434 | L | P | G | S | S | G | R | R | V | 3 | 4118 |
| 436 | G | S | S | G | R | R | V | T | Q | 3 | 4119 |
| 452 | A | Q | K | V | Q | P | P | V | E | 3 | 4120 |
| 455 | V | Q | P | P | V | E | L | F | V | 3 | 4121 |
| 475 | L | S | F | V | P | A | P | D | G | 3 | 4122 |
| 500 | F | Q | E | K | Q | K | C | G | H | 3 | 4123 |
| 541 | N | K | F | V | Q | S | C | I | D | 3 | 4124 |
| 557 | R | E | L | G | L | A | E | C | D | 3 | 4125 |
| 573 | F | K | T | E | R | K | K | A | T | 3 | 4126 |
| 640 | L | H | G | E | V | H | C | G | T | 3 | 4127 |
| 644 | V | H | C | G | T | N | V | C | R | 3 | 4128 |
| 653 | K | P | F | S | F | K | W | W | N | 3 | 4129 |
| 7 | V | R | V | S | L | E | H | P | T | 2 | 4130 |
| 29 | I | Y | G | S | V | P | E | G | T | 2 | 4131 |
| 40 | F | E | V | Y | V | G | T | P | G | V | 2 | 4132 |
| 52 | I | S | P | N | M | E | R | G | R | 2 | 4133 |
| 58 | R | G | R | E | R | A | D | T | R | 2 | 4134 |
| 70 | F | D | A | T | L | E | I | I | V | 2 | 4135 |
| 90 | S | H | V | Q | I | S | Y | H | S | 2 | 4136 |
| 94 | I | S | Y | H | S | S | H | E | P | 2 | 4137 |
| 96 | Y | H | S | S | H | E | P | L | P | 2 | 4138 |
| 117 | I | S | L | D | C | D | L | N | C | 2 | 4139 |
| 137 | R | Q | W | V | W | G | P | S | G | 2 | 4140 |
| 154 | C | D | R | D | D | P | S | C | D | 2 | 4141 |
| 159 | P | S | C | D | V | Q | D | N | C | 2 | 4142 |
| 160 | S | C | D | V | Q | D | N | C | D | 2 | 4143 |
| 171 | V | H | C | L | Q | D | L | E | D | 2 | 4144 |
| 182 | V | M | V | L | R | T | Q | G | P | 2 | 4145 |
| 187 | T | Q | G | P | A | A | L | F | D | 2 | 4146 |
| 190 | P | A | A | L | F | D | D | H | K | 2 | 4147 |
| 197 | H | K | L | V | L | H | T | S | S | 2 | 4148 |
| 204 | S | S | Y | D | A | K | R | A | Q | 2 | 4149 |
| 214 | F | H | I | C | G | P | E | D | V | 2 | 4150 |
| 219 | P | E | D | V | C | E | A | Y | R | 2 | 4151 |
| 223 | C | E | A | Y | R | H | V | L | G | 2 | 4152 |
| 226 | Y | R | H | V | L | G | Q | D | K | 2 | 4153 |
| 235 | V | S | Y | E | V | P | R | L | H | 2 | 4154 |
| 265 | I | S | F | H | V | T | L | L | D | 2 | 4155 |
| 272 | L | D | D | S | N | E | D | F | S | 2 | 4156 |
| 282 | S | P | I | F | T | D | T | V | V | 2 | 4157 |
| 294 | A | P | W | I | M | T | P | S | T | 2 | 4158 |
| 299 | T | P | S | T | L | P | P | L | E | 2 | 4159 |
| 320 | V | D | A | V | A | E | L | A | R | 2 | 4160 |
| 324 | A | E | L | A | R | K | A | G | C | 2 | 4161 |
| 330 | A | G | C | K | L | T | I | C | P | 2 | 4162 |
| 332 | C | K | L | T | I | C | P | Q | A | 2 | 4163 |
| 342 | N | R | N | D | R | W | I | Q | D | 2 | 4164 |
| 355 | G | Y | V | Q | A | P | H | K | T | 2 | 4165 |
| 358 | Q | A | P | H | K | T | L | P | V | 2 | 4166 |
| 382 | K | R | I | L | G | P | D | F | G | 2 | 4167 |
| 385 | L | G | P | D | F | G | Y | V | T | 2 | 4168 |
| 390 | G | Y | V | T | R | E | P | R | D | 2 | 4169 |
| 394 | R | E | P | R | D | R | S | V | S | 2 | 4170 |
| 410 | L | E | V | S | P | P | V | V | A | 2 | 4171 |
| 413 | S | P | P | V | V | A | N | G | K | 2 | 4172 |
| 430 | I | G | G | N | L | P | G | S | S | 2 | 4173 |
| 431 | G | G | N | L | P | G | S | S | G | 2 | 4174 |
| 451 | H | A | Q | K | V | Q | P | P | V | 2 | 4175 |
| 479 | P | A | P | D | G | K | G | F | R | 2 | 4176 |
| 486 | F | R | M | L | L | A | S | P | G | 2 | 4177 |
| 487 | R | M | L | L | A | S | P | G | A | 2 | 4178 |
| 490 | L | A | S | P | G | A | C | F | K | 2 | 4179 |
| 497 | F | K | L | F | Q | E | K | Q | K | 2 | 4180 |
| 503 | K | Q | K | C | G | H | G | R | A | 2 | 4181 |
| 528 | I | N | Q | V | L | S | N | K | D | 2 | 4182 |
| 534 | N | K | D | L | I | N | Y | N | K | 2 | 4183 |

TABLE XXVII-continued

| Pos | 1 | 2 | 3 | 4 | 5 | 6 | 7 | 8 | 9 | score | SEQ. ID NO. |
|---|---|---|---|---|---|---|---|---|---|---|---|
| 540 | Y | N | K | F | V | Q | S | C | I | 2 | 4184 |
| 570 | P | Q | L | F | K | T | E | R | K | 2 | 4185 |
| 581 | T | A | F | F | P | D | L | V | N | 2 | 4186 |
| 584 | F | P | D | L | V | N | M | L | V | 2 | 4187 |
| 593 | L | G | K | H | L | G | I | P | K | 2 | 4188 |
| 604 | G | P | I | I | N | G | C | C | C | 2 | 4189 |
| 609 | G | C | C | C | L | E | E | K | V | 2 | 4190 |
| 617 | V | R | S | L | L | E | P | L | G | 2 | 4191 |
| 636 | P | Y | H | M | L | H | G | E | V | 2 | 4192 |
| 638 | H | M | L | H | G | E | V | H | C | 2 | 4193 |
| 42 | V | Y | G | T | P | G | V | D | I | 1 | 4194 |
| 53 | S | P | N | M | E | R | G | R | E | 1 | 4195 |
| 55 | N | M | E | R | G | R | E | R | A | 1 | 4196 |
| 59 | G | R | E | R | A | D | T | R | R | 1 | 4197 |
| 60 | R | E | R | A | D | T | R | R | W | 1 | 4198 |
| 113 | T | C | V | D | I | S | L | D | C | 1 | 4199 |
| 121 | C | D | L | N | C | E | G | R | Q | 1 | 4200 |
| 127 | G | R | Q | D | R | N | F | V | D | 1 | 4201 |
| 152 | V | N | C | D | R | D | D | P | S | 1 | 4202 |
| 161 | C | D | V | Q | D | N | C | D | Q | 1 | 4203 |
| 203 | T | S | S | Y | D | A | K | R | A | 1 | 4204 |
| 227 | R | H | V | L | G | Q | D | K | V | 1 | 4205 |
| 236 | S | Y | E | V | P | R | L | H | G | 1 | 4206 |
| 239 | V | P | R | L | H | G | D | E | E | 1 | 4207 |
| 240 | P | R | L | H | G | D | E | E | R | 1 | 4208 |
| 281 | A | S | P | I | F | T | D | T | V | 1 | 4209 |
| 291 | F | R | V | A | P | W | I | M | T | 1 | 4210 |
| 300 | P | S | T | L | P | P | L | E | V | 1 | 4211 |
| 323 | V | A | E | L | A | R | K | A | G | 1 | 4212 |
| 327 | A | R | K | A | G | C | K | L | T | 1 | 4213 |
| 337 | C | P | Q | A | E | N | R | N | D | 1 | 4214 |
| 339 | Q | A | E | N | R | N | D | R | W | 1 | 4215 |
| 364 | L | P | V | V | F | D | S | P | R | 1 | 4216 |
| 370 | S | P | R | N | G | E | L | Q | D | 1 | 4217 |
| 397 | R | D | R | S | V | S | G | L | D | 1 | 4218 |
| 401 | V | S | G | L | D | S | F | G | N | 1 | 4219 |
| 404 | L | D | S | F | G | N | L | E | V | 1 | 4220 |
| 414 | P | P | V | V | A | N | G | K | E | 1 | 4221 |
| 435 | P | G | S | S | G | R | R | V | T | 1 | 4222 |
| 438 | S | G | R | R | V | T | Q | V | V | 1 | 4223 |
| 439 | G | R | R | V | T | Q | V | V | R | 1 | 4224 |
| 471 | V | D | E | F | L | S | F | V | P | 1 | 4225 |
| 493 | P | G | A | C | F | K | L | F | Q | 1 | 4226 |
| 514 | F | Q | G | V | V | D | D | E | Q | 1 | 4227 |
| 515 | Q | G | V | V | D | D | E | Q | V | 1 | 4228 |
| 544 | V | Q | S | C | I | D | W | N | R | 1 | 4229 |
| 545 | Q | S | C | I | D | W | N | R | E | 1 | 4230 |
| 548 | I | D | W | N | R | E | V | L | K | 1 | 4231 |
| 552 | R | E | V | L | K | R | E | L | G | 1 | 4232 |
| 569 | I | P | Q | L | F | K | T | E | R | 1 | 4233 |
| 577 | R | K | K | A | T | A | F | F | P | 1 | 4234 |
| 600 | P | K | P | F | G | P | I | I | N | 1 | 4235 |
| 603 | F | G | P | I | I | N | G | C | C | 1 | 4236 |
| 607 | I | N | G | C | C | C | L | E | E | 1 | 4237 |
| 642 | G | E | V | H | C | G | T | N | V | 1 | 4238 |
| 646 | C | G | T | N | V | C | R | K | P | 1 | 4239 |
| 648 | T | N | V | C | R | K | P | F | S | 1 | 4240 |

184P1E2 v.2: HLA Peptide
Scoring Results A26 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 3 | M | T | P | S | T | L | A | P | L | 25 | 4241 |
| 6 | S | T | L | A | P | L | E | V | Y | 24 | 4242 |
| 7 | T | L | A | P | L | E | V | Y | Y | 13 | 4243 |
| 1 | W | I | M | T | P | S | T | L | A | 10 | 4244 |
| 9 | A | P | L | E | V | Y | Y | C | R | 7 | 4245 |
| 8 | L | A | P | L | E | V | Y | Y | C | 5 | 4246 |
| 2 | I | M | T | P | S | T | L | A | P | 4 | 4247 |
| 4 | T | P | S | T | L | A | P | L | E | 2 | 4248 |
| 5 | P | S | T | L | A | P | L | E | V | 1 | 4249 |

184P1E2 v.3: HLA Peptide
Scoring Results A26 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 2 | E | F | L | S | F | V | P | V | P | 18 | 4250 |
| 1 | D | E | F | L | S | F | V | P | V | 14 | 4251 |
| 7 | V | P | V | P | D | G | K | G | F | 13 | 4252 |
| 9 | V | P | D | G | K | G | F | R | M | 13 | 4253 |
| 6 | F | V | P | V | P | D | G | K | G | 12 | 4254 |
| 8 | P | V | P | D | G | K | G | F | R | 12 | 4255 |
| 3 | F | L | S | F | V | P | V | P | D | 9 | 4256 |
| 5 | S | F | V | P | V | P | D | G | K | 9 | 4257 |
| 4 | L | S | F | V | P | V | P | D | G | 7 | 4258 |

TABLE XXVIII

| Pos | 1 | 2 | 3 | 4 | 5 | 6 | 7 | 8 | 9 | score | SEQ. ID NO. |
|---|---|---|---|---|---|---|---|---|---|---|---|

184P1E2 v.1: HLA Peptide
Scoring Results B 0702 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 142 | G | P | S | G | Y | G | G | I | L | 25 | 4259 |
| 256 | F | P | D | A | G | F | T | G | L | 24 | 4260 |
| 480 | A | P | D | G | K | G | F | R | M | 22 | 4261 |
| 359 | A | P | H | K | T | L | P | V | V | 21 | 4262 |
| 294 | A | P | W | I | M | T | P | S | T | 20 | 4263 |
| 599 | I | P | K | P | F | G | P | I | I | 20 | 4264 |
| 101 | E | P | L | P | L | A | Y | A | V | 19 | 4265 |
| 478 | V | P | A | P | D | G | K | G | F | 19 | 4266 |
| 492 | S | P | G | A | C | F | K | L | F | 19 | 4267 |
| 622 | E | P | L | G | L | H | C | T | F | 19 | 4268 |
| 13 | H | P | T | S | A | V | C | V | A | 18 | 4269 |
| 282 | S | P | I | F | T | D | T | V | V | 18 | 4270 |
| 434 | L | P | G | S | S | G | R | R | V | 18 | 4271 |
| 584 | F | P | D | L | V | N | M | L | V | 17 | 4272 |
| 601 | K | P | F | G | P | I | I | N | G | 16 | 4273 |
| 3 | L | Q | R | I | V | R | V | S | L | 15 | 4274 |
| 97 | H | S | S | H | E | P | L | P | L | 15 | 4275 |
| 234 | K | V | S | Y | E | V | P | R | L | 15 | 4276 |
| 395 | E | P | R | D | R | S | V | S | G | 15 | 4277 |
| 453 | Q | K | V | Q | P | P | V | E | L | 15 | 4278 |
| 104 | P | L | A | Y | A | V | L | Y | L | 14 | 4279 |
| 193 | L | F | D | D | H | K | L | V | L | 14 | 4280 |
| 246 | E | E | R | F | F | V | E | G | L | 14 | 4281 |
| 264 | L | I | S | F | H | V | T | L | L | 14 | 4282 |
| 326 | L | A | R | K | A | G | C | K | L | 14 | 4283 |
| 356 | Y | V | Q | A | P | H | K | T | L | 14 | 4284 |
| 370 | S | P | R | N | G | E | L | Q | D | 14 | 4285 |
| 423 | Y | P | L | G | R | I | L | I | G | 14 | 4286 |
| 467 | A | V | G | H | V | D | E | F | L | 14 | 4287 |
| 491 | A | S | P | G | A | C | F | K | L | 14 | 4288 |
| 504 | Q | K | C | G | H | G | R | A | L | 14 | 4289 |
| 505 | K | C | G | H | G | R | A | L | L | 14 | 4290 |
| 553 | E | V | L | K | R | E | L | G | L | 14 | 4291 |
| 579 | K | A | T | A | F | F | P | D | L | 14 | 4292 |
| 616 | K | V | R | S | L | L | E | P | L | 14 | 4293 |
| 33 | V | P | E | G | T | E | M | F | E | 13 | 4294 |
| 42 | V | Y | G | T | P | G | V | D | I | 13 | 4295 |
| 79 | V | M | N | S | P | S | N | D | L | 13 | 4296 |
| 103 | L | P | L | A | Y | A | V | L | Y | 13 | 4297 |
| 158 | D | P | S | C | D | V | Q | D | N | 13 | 4298 |
| 177 | L | E | D | M | S | V | M | V | L | 13 | 4299 |
| 186 | R | T | Q | G | P | A | A | L | F | 13 | 4300 |
| 189 | G | P | A | A | L | F | D | D | H | 13 | 4301 |
| 222 | V | C | E | A | Y | R | H | V | L | 13 | 4302 |
| 239 | V | P | R | L | H | G | D | E | E | 13 | 4303 |
| 299 | T | P | S | T | L | P | P | L | E | 13 | 4304 |
| 368 | F | D | S | P | R | N | G | E | L | 13 | 4305 |
| 379 | F | P | Y | K | R | I | L | G | P | 13 | 4306 |
| 386 | G | P | D | F | G | Y | V | T | R | 13 | 4307 |
| 417 | V | A | N | G | K | E | Y | P | L | 13 | 4308 |
| 421 | K | E | Y | P | L | G | R | I | L | 13 | 4309 |
| 457 | P | P | V | E | L | F | V | D | W | 13 | 4310 |
| 481 | P | D | G | K | G | F | R | M | L | 13 | 4311 |
| 482 | D | G | K | G | F | R | M | L | L | 13 | 4312 |
| 547 | C | I | D | W | N | R | E | V | L | 13 | 4313 |
| 585 | P | D | L | V | N | M | L | V | L | 13 | 4314 |
| 618 | R | S | L | L | E | P | L | G | L | 13 | 4315 |
| 632 | D | D | F | T | P | Y | H | M | L | 13 | 4316 |
| 18 | V | C | V | A | G | V | E | T | L | 12 | 4317 |

TABLE XXVIII-continued

| Pos | 1 | 2 | 3 | 4 | 5 | 6 | 7 | 8 | 9 | score | SEQ. ID NO. |
|---|---|---|---|---|---|---|---|---|---|---|---|
| 66 | R | R | W | R | F | D | A | T | L | 12 | 4318 |
| 82 | S | P | S | N | D | L | N | D | S | 12 | 4319 |
| 102 | P | L | P | L | A | Y | A | V | L | 12 | 4320 |
| 143 | P | S | G | Y | G | G | I | L | L | 12 | 4321 |
| 166 | N | C | D | Q | H | V | H | C | L | 12 | 4322 |
| 185 | L | R | T | Q | G | P | A | A | L | 12 | 4323 |
| 191 | A | A | L | F | D | D | H | K | L | 12 | 4324 |
| 208 | A | K | R | A | Q | V | F | H | I | 12 | 4325 |
| 253 | G | L | S | F | P | D | A | G | F | 12 | 4326 |
| 263 | G | L | I | S | F | H | V | T | L | 12 | 4327 |
| 298 | M | T | P | S | T | L | P | P | L | 12 | 4328 |
| 303 | L | P | P | L | E | V | Y | V | C | 12 | 4329 |
| 304 | P | P | L | E | V | Y | V | C | R | 12 | 4330 |
| 318 | C | F | V | D | A | V | A | E | L | 12 | 4331 |
| 328 | R | K | A | G | C | K | L | T | I | 12 | 4332 |
| 396 | P | R | D | R | S | V | S | G | L | 12 | 4333 |
| 410 | L | E | V | S | P | P | V | V | A | 12 | 4334 |
| 442 | V | T | Q | V | V | R | D | F | L | 12 | 4335 |
| 454 | K | V | Q | P | P | V | E | L | F | 12 | 4336 |
| 489 | L | L | A | S | P | G | A | C | F | 12 | 4337 |
| 524 | K | T | I | S | I | N | Q | V | L | 12 | 4338 |
| 569 | I | P | Q | L | F | K | T | E | R | 12 | 4339 |
| 598 | G | I | P | K | P | F | G | P | I | 12 | 4340 |
| 613 | L | E | E | K | V | R | S | L | L | 12 | 4341 |
| 10 | S | L | E | H | P | T | S | A | V | 11 | 4342 |
| 17 | A | V | C | V | A | G | V | E | T | 11 | 4343 |
| 45 | T | P | G | V | D | I | Y | I | S | 11 | 4344 |
| 53 | S | P | N | M | E | R | G | R | E | 11 | 4345 |
| 72 | A | T | L | E | I | I | V | V | M | 11 | 4346 |
| 95 | S | Y | H | S | S | H | E | P | L | 11 | 4347 |
| 126 | E | G | R | Q | D | R | N | F | V | 11 | 4348 |
| 179 | D | M | S | V | M | V | L | R | T | 11 | 4349 |
| 184 | V | L | R | T | Q | G | P | A | A | 11 | 4350 |
| 218 | G | P | E | D | V | C | E | A | Y | 11 | 4351 |
| 280 | S | A | S | P | I | F | T | D | T | 11 | 4352 |
| 300 | P | S | T | L | P | P | L | E | V | 11 | 4353 |
| 312 | R | V | R | N | N | T | C | F | V | 11 | 4354 |
| 337 | C | P | Q | A | E | N | R | N | D | 11 | 4355 |
| 346 | R | W | I | Q | D | E | M | E | L | 11 | 4356 |
| 364 | L | P | V | V | F | D | S | P | R | 11 | 4357 |
| 377 | Q | D | F | P | Y | K | R | I | L | 11 | 4358 |
| 402 | S | G | L | D | S | F | G | N | L | 11 | 4359 |
| 411 | E | V | S | P | P | V | V | A | N | 11 | 4360 |
| 426 | G | R | I | L | I | G | G | N | L | 11 | 4361 |
| 456 | Q | P | P | V | E | L | F | V | D | 11 | 4362 |
| 458 | P | V | E | L | F | V | D | W | L | 11 | 4363 |
| 564 | C | D | I | I | D | I | P | Q | L | 11 | 4364 |
| 575 | T | E | R | K | K | A | T | A | F | 11 | 4365 |
| 576 | E | R | K | K | A | T | A | F | F | 11 | 4366 |
| 582 | A | F | F | P | D | L | V | N | M | 11 | 4367 |
| 583 | F | F | P | D | L | V | N | M | L | 11 | 4368 |
| 589 | N | M | L | V | L | G | K | H | L | 11 | 4369 |
| 604 | G | P | I | I | N | G | C | C | C | 11 | 4370 |
| 612 | C | L | E | E | K | V | R | S | L | 11 | 4371 |
| 653 | K | P | F | S | F | K | W | W | N | 11 | 4372 |
| 19 | C | V | A | G | V | E | T | L | V | 10 | 4373 |
| 21 | A | G | V | E | T | L | V | D | I | 10 | 4374 |
| 57 | E | R | G | R | E | R | A | D | T | 10 | 4375 |
| 65 | T | R | W | R | F | D | A | T | L | 10 | 4376 |
| 98 | S | S | H | E | P | L | P | L | A | 10 | 4377 |
| 100 | H | E | P | L | P | L | A | Y | A | 10 | 4378 |
| 111 | Y | L | T | C | V | D | I | S | L | 10 | 4379 |
| 115 | V | D | I | S | L | D | C | D | L | 10 | 4380 |
| 144 | S | G | Y | G | G | I | L | L | V | 10 | 4381 |
| 155 | D | R | D | D | P | S | C | D | V | 10 | 4382 |
| 169 | Q | H | V | H | C | L | Q | D | L | 10 | 4383 |
| 195 | D | D | H | K | L | V | L | H | T | 10 | 4384 |
| 205 | S | Y | D | A | K | R | A | Q | V | 10 | 4385 |
| 248 | R | F | F | V | E | G | L | S | F | 10 | 4386 |
| 257 | P | D | A | G | F | T | G | L | I | 10 | 4387 |
| 278 | D | F | S | A | S | P | I | F | T | 10 | 4388 |
| 283 | P | I | F | T | D | T | V | V | F | 10 | 4389 |
| 291 | F | R | V | A | P | W | I | M | T | 10 | 4390 |
| 295 | P | W | I | M | T | P | S | T | L | 10 | 4391 |
| 314 | R | N | N | T | C | F | V | D | A | 10 | 4392 |
| 358 | Q | A | P | H | K | T | L | P | V | 10 | 4393 |
| 376 | L | Q | D | F | P | Y | K | R | I | 10 | 4394 |
| 381 | Y | K | R | I | L | G | P | D | F | 10 | 4395 |
| 384 | I | L | G | P | D | F | G | Y | V | 10 | 4396 |
| 404 | L | D | S | F | G | N | L | E | V | 10 | 4397 |
| 413 | S | P | P | V | V | A | N | G | K | 10 | 4398 |
| 414 | P | P | V | V | A | N | G | K | E | 10 | 4399 |
| 435 | P | G | S | S | G | R | R | V | T | 10 | 4400 |
| 438 | S | G | R | R | V | T | Q | V | V | 10 | 4401 |
| 455 | V | Q | P | P | V | E | L | F | V | 10 | 4402 |
| 460 | E | L | F | V | D | W | L | A | V | 10 | 4403 |
| 472 | D | E | F | L | S | F | V | P | A | 10 | 4404 |
| 506 | C | G | H | G | R | A | L | L | F | 10 | 4405 |
| 529 | N | Q | V | L | S | N | K | D | L | 10 | 4406 |
| 551 | N | R | E | V | L | K | R | E | L | 10 | 4407 |
| 591 | L | V | L | G | K | H | L | G | I | 10 | 4408 |
| 595 | K | H | L | G | I | P | K | P | F | 10 | 4409 |
| 605 | P | I | I | N | G | C | C | C | L | 10 | 4410 |
| 635 | T | P | Y | H | M | L | H | G | E | 10 | 4411 |
| 12 | E | H | P | T | S | A | V | C | V | 9 | 4412 |
| 15 | T | S | A | V | C | V | A | G | V | 9 | 4413 |
| 31 | G | S | V | P | E | G | T | E | M | 9 | 4414 |
| 62 | R | A | D | T | R | W | R | F | | 9 | 4415 |
| 64 | D | T | R | R | W | R | F | D | A | 9 | 4416 |
| 68 | W | R | F | D | A | T | L | E | I | 9 | 4417 |
| 69 | R | F | D | A | T | L | E | I | I | 9 | 4418 |
| 206 | Y | D | A | K | R | A | Q | V | F | 9 | 4419 |
| 241 | R | L | H | G | D | E | E | R | F | 9 | 4420 |
| 243 | H | G | D | E | E | R | F | F | V | 9 | 4421 |
| 251 | V | E | G | L | S | F | P | D | A | 9 | 4422 |
| 281 | A | S | P | I | F | T | D | T | V | 9 | 4423 |
| 302 | T | L | P | P | L | E | V | Y | V | 9 | 4424 |
| 322 | A | V | A | E | L | A | R | K | A | 9 | 4425 |
| 327 | A | R | K | A | G | C | K | L | T | 9 | 4426 |
| 351 | E | M | E | L | G | Y | V | Q | A | 9 | 4427 |
| 360 | P | H | K | T | L | P | V | V | F | 9 | 4428 |
| 420 | G | K | E | Y | P | L | G | R | I | 9 | 4429 |
| 437 | S | S | G | R | R | V | T | Q | V | 9 | 4430 |
| 444 | Q | V | V | R | D | F | L | H | A | 9 | 4431 |
| 451 | H | A | Q | K | V | Q | P | P | V | 9 | 4432 |
| 466 | L | A | V | G | H | V | D | E | F | 9 | 4433 |
| 469 | G | H | V | D | E | F | L | S | F | 9 | 4434 |
| 483 | G | K | G | F | R | M | L | L | A | 9 | 4435 |
| 517 | V | V | D | D | E | Q | V | K | T | 9 | 4436 |
| 580 | A | T | A | F | F | P | D | L | V | 9 | 4437 |
| 623 | P | L | G | L | H | C | T | F | I | 9 | 4438 |
| 1 | M | S | L | Q | R | I | V | R | V | 8 | 4439 |
| 29 | I | Y | G | S | V | P | E | G | T | 8 | 4440 |
| 37 | T | E | M | F | E | V | Y | G | T | 8 | 4441 |
| 40 | F | E | V | Y | G | T | P | G | V | 8 | 4442 |
| 44 | G | T | P | G | V | D | I | Y | I | 8 | 4443 |
| 86 | D | L | N | D | S | H | V | Q | I | 8 | 4444 |
| 109 | V | L | Y | L | T | C | V | D | I | 8 | 4445 |
| 176 | D | L | E | D | M | S | V | M | V | 8 | 4446 |
| 192 | A | L | F | D | D | H | K | L | V | 8 | 4447 |
| 203 | T | S | S | Y | D | A | K | R | A | 8 | 4448 |
| 231 | G | Q | D | K | V | S | Y | E | V | 8 | 4449 |
| 242 | L | H | G | D | E | E | R | F | F | 8 | 4450 |
| 254 | L | S | F | P | D | A | G | F | T | 8 | 4451 |
| 259 | A | G | F | T | G | L | I | S | F | 8 | 4452 |
| 262 | T | G | L | I | S | F | H | V | T | 8 | 4453 |
| 273 | D | D | S | N | E | D | F | S | A | 8 | 4454 |
| 276 | N | E | D | F | S | A | S | P | I | 8 | 4455 |
| 277 | E | D | F | S | A | S | P | I | F | 8 | 4456 |
| 285 | F | T | D | T | V | V | F | R | V | 8 | 4457 |
| 286 | T | D | T | V | V | F | R | V | A | 8 | 4458 |
| 290 | V | F | R | V | A | P | W | I | M | 8 | 4459 |
| 315 | N | N | T | C | F | V | D | A | V | 8 | 4460 |
| 316 | N | T | C | F | V | D | A | V | A | 8 | 4461 |
| 319 | F | V | D | A | V | A | E | L | A | 8 | 4462 |
| 340 | A | E | N | R | N | D | R | W | I | 8 | 4463 |
| 344 | N | D | R | W | I | Q | D | E | M | 8 | 4464 |
| 371 | P | R | G | E | L | Q | D | F | P | 8 | 4465 |
| 385 | L | G | P | D | F | G | Y | V | T | 8 | 4466 |
| 408 | G | N | L | E | V | S | P | P | V | 8 | 4467 |
| 409 | N | L | E | V | S | P | P | V | V | 8 | 4468 |
| 422 | E | Y | P | L | G | R | I | L | I | 8 | 4469 |

TABLE XXVIII-continued

| Pos | 1 | 2 | 3 | 4 | 5 | 6 | 7 | 8 | 9 | score | SEQ. ID NO. |
|---|---|---|---|---|---|---|---|---|---|---|---|
| 441 | R | V | T | Q | V | V | R | D | F | 8 | 4470 |
| 470 | H | V | D | E | F | L | S | F | V | 8 | 4471 |
| 487 | R | M | L | L | A | S | P | G | A | 8 | 4472 |
| 509 | G | R | A | L | L | F | Q | G | V | 8 | 4473 |
| 510 | R | A | L | L | F | Q | G | V | V | 8 | 4474 |
| 518 | V | D | D | E | Q | V | K | T | I | 8 | 4475 |
| 558 | E | L | G | L | A | E | C | D | I | 8 | 4476 |
| 566 | I | I | D | I | P | Q | L | F | K | 8 | 4477 |
| 567 | I | D | I | P | Q | L | F | K | T | 8 | 4478 |
| 574 | K | T | E | R | K | K | A | T | A | 8 | 4479 |
| 631 | I | D | D | F | T | P | Y | H | M | 8 | 4480 |
| 642 | G | E | V | H | C | G | T | N | V | 8 | 4481 |
| 647 | G | T | N | V | C | R | K | P | F | 8 | 4482 |
| 650 | V | C | R | K | P | F | S | F | K | 8 | 4483 |
| 654 | P | F | S | F | K | W | W | N | M | 8 | 4484 |
| 7 | V | R | V | S | L | E | H | P | T | 7 | 4485 |
| 9 | V | S | L | E | H | P | T | S | A | 7 | 4486 |
| 32 | S | V | P | E | G | T | E | M | F | 7 | 4487 |
| 34 | P | E | G | T | E | M | F | E | V | 7 | 4488 |
| 48 | V | D | I | Y | I | S | P | N | M | 7 | 4489 |
| 55 | N | M | E | R | G | R | E | R | A | 7 | 4490 |
| 70 | F | D | A | T | L | E | I | I | V | 7 | 4491 |
| 71 | D | A | T | L | E | I | I | V | V | 7 | 4492 |
| 84 | S | N | D | L | N | D | S | H | V | 7 | 4493 |
| 105 | L | A | Y | A | V | L | Y | L | T | 7 | 4494 |
| 107 | Y | A | V | L | Y | L | T | C | V | 7 | 4495 |
| 125 | C | E | G | R | Q | D | R | N | F | 7 | 4496 |
| 132 | N | F | V | D | K | R | Q | W | V | 7 | 4497 |
| 163 | V | Q | D | N | C | D | Q | H | V | 7 | 4498 |
| 174 | L | Q | D | L | E | D | M | S | V | 7 | 4499 |
| 175 | Q | D | L | E | D | M | S | V | M | 7 | 4500 |
| 183 | M | V | L | R | T | Q | G | P | A | 7 | 4501 |
| 217 | C | G | P | E | D | V | C | E | A | 7 | 4502 |
| 227 | R | H | V | L | G | Q | D | K | V | 7 | 4503 |
| 261 | F | T | G | L | I | S | F | H | V | 7 | 4504 |
| 271 | L | L | D | D | S | N | E | D | F | 7 | 4505 |
| 289 | V | V | F | R | V | A | P | W | I | 7 | 4506 |
| 305 | P | L | E | V | V | C | R | V | 7 |   | 4507 |
| 309 | Y | V | C | R | V | R | N | N | T | 7 | 4508 |
| 311 | C | R | V | R | N | N | T | C | F | 7 | 4509 |
| 332 | C | K | L | T | I | C | P | Q | A | 7 | 4510 |
| 361 | H | K | T | L | P | V | V | F | D | 7 | 4511 |
| 393 | T | R | E | P | R | D | R | S | V | 7 | 4512 |
| 399 | R | S | V | S | G | L | D | S | F | 7 | 4513 |
| 436 | G | S | S | G | R | R | V | T | Q | 7 | 4514 |
| 447 | R | D | F | L | H | A | Q | K | V | 7 | 4515 |
| 463 | V | D | W | L | A | V | G | H | V | 7 | 4516 |
| 503 | K | Q | K | C | G | H | G | R | A | 7 | 4517 |
| 520 | D | E | Q | V | K | T | I | S | I | 7 | 4518 |
| 535 | K | D | L | I | N | Y | N | K | F | 7 | 4519 |
| 536 | D | L | I | N | Y | N | K | F | V | 7 | 4520 |
| 559 | L | G | L | A | E | C | D | I | I | 7 | 4521 |
| 572 | L | F | K | T | E | R | K | K | A | 7 | 4522 |
| 573 | F | K | T | E | R | K | K | A | T | 7 | 4523 |
| 627 | H | C | T | F | I | D | D | F | T | 7 | 4524 |
| 640 | L | H | G | E | V | H | C | G | T | 7 | 4525 |
| 655 | F | S | F | K | W | W | N | M | V | 7 | 4526 |
| 14 | P | T | S | A | V | C | V | A | G | 6 | 4527 |
| 25 | T | L | V | D | I | Y | G | S | V | 6 | 4528 |
| 141 | W | G | P | S | G | Y | G | G | I | 6 | 4529 |
| 145 | G | Y | G | G | I | L | L | V | N | 6 | 4530 |
| 172 | H | C | L | Q | D | L | E | D | M | 6 | 4531 |
| 200 | V | L | H | T | S | S | Y | D | A | 6 | 4532 |
| 214 | F | H | I | C | G | P | E | D | V | 6 | 4533 |
| 215 | H | I | C | G | P | E | D | V | C | 6 | 4534 |
| 221 | D | V | C | E | A | Y | R | H | V | 6 | 4535 |
| 236 | S | Y | E | V | P | R | L | H | G | 6 | 4536 |
| 297 | I | M | T | P | S | T | L | P | P | 6 | 4537 |
| 349 | Q | D | E | M | E | L | G | Y | V | 6 | 4538 |
| 355 | G | Y | V | Q | A | P | H | K | T | 6 | 4539 |
| 383 | R | I | L | G | P | D | F | G | Y | 6 | 4540 |
| 392 | V | T | R | E | P | R | D | R | S | 6 | 4541 |
| 428 | I | L | I | G | G | N | L | P | G | 6 | 4542 |
| 459 | V | E | L | F | V | D | W | L | A | 6 | 4543 |
| 511 | A | L | L | F | Q | G | V | V | D | 6 | 4544 |
| 515 | Q | G | V | V | D | D | E | Q | V | 6 | 4545 |
| 523 | V | K | T | I | S | I | N | Q | V | 6 | 4546 |
| 530 | Q | V | L | S | N | K | D | L | I | 6 | 4547 |
| 540 | Y | N | K | F | V | Q | S | C | I | 6 | 4548 |
| 546 | S | C | I | D | W | N | R | E | V | 6 | 4549 |
| 554 | V | L | K | R | E | L | G | L | A | 6 | 4550 |
| 555 | L | K | R | E | L | G | L | A | E | 6 | 4551 |
| 561 | L | A | E | C | D | I | I | D | I | 6 | 4552 |
| 565 | D | I | I | D | I | P | Q | L | F | 6 | 4553 |
| 581 | T | A | F | F | P | D | L | V | N | 6 | 4554 |
| 596 | H | L | G | I | P | K | P | F | G | 6 | 4555 |
| 609 | G | C | C | C | L | E | E | K | V | 6 | 4556 |
| 621 | L | E | P | L | G | L | H | C | T | 6 | 4557 |
| 626 | L | H | C | T | F | I | D | D | F | 6 | 4558 |
| 636 | P | Y | H | M | L | H | G | E | V | 6 | 4559 |
| 649 | N | V | C | R | K | P | F | S | F | 6 | 4560 |
| 20 | V | A | G | V | E | T | L | V | D | 5 | 4561 |
| 30 | Y | G | S | V | P | E | G | T | E | 5 | 4562 |
| 56 | M | E | R | G | R | E | R | A | D | 5 | 4563 |
| 60 | R | E | R | A | D | T | R | R | W | 5 | 4564 |
| 106 | A | Y | A | V | L | Y | L | T | C | 5 | 4565 |
| 128 | R | Q | D | R | N | F | V | D | K | 5 | 4566 |
| 139 | W | V | W | G | P | S | G | Y | G | 5 | 4567 |
| 187 | T | Q | G | P | A | A | L | F | D | 5 | 4568 |
| 216 | I | C | G | P | E | D | V | C | E | 5 | 4569 |
| 284 | I | F | T | D | T | V | V | F | R | 5 | 4570 |
| 296 | W | I | M | T | P | S | T | L | P | 5 | 4571 |
| 301 | S | T | L | P | P | L | E | V | Y | 5 | 4572 |
| 367 | V | F | D | S | P | R | N | G | E | 5 | 4573 |
| 398 | D | R | S | V | S | G | L | D | S | 5 | 4574 |
| 400 | S | V | S | G | L | D | S | F | G | 5 | 4575 |
| 418 | A | N | G | K | E | Y | P | L | G | 5 | 4576 |
| 439 | G | R | R | V | T | Q | V | V | R | 5 | 4577 |
| 8 | R | V | S | L | E | H | P | T | S | 4 | 4578 |
| 28 | D | I | Y | G | S | V | P | E | G | 4 | 4579 |
| 41 | E | V | Y | G | T | P | G | V | D | 4 | 4580 |
| 50 | I | Y | I | S | P | N | M | E | R | 4 | 4581 |
| 67 | R | W | R | F | D | A | T | L | E | 4 | 4582 |
| 99 | S | H | E | P | L | P | L | A | Y | 4 | 4583 |
| 108 | A | V | L | Y | L | T | C | V | D | 4 | 4584 |
| 156 | R | D | D | P | S | C | D | V | Q | 4 | 4585 |
| 178 | E | D | M | S | V | M | V | L | R | 4 | 4586 |
| 224 | E | A | Y | R | H | V | L | G | Q | 4 | 4587 |
| 225 | A | Y | R | H | V | L | G | Q | D | 4 | 4588 |
| 258 | D | A | G | F | T | G | L | I | S | 4 | 4589 |
| 265 | I | S | F | H | V | T | L | L | D | 4 | 4590 |
| 279 | F | S | A | S | P | I | F | T | D | 4 | 4591 |
| 287 | D | T | V | V | F | R | V | A | P | 4 | 4592 |
| 307 | E | V | Y | V | C | R | V | R | N | 4 | 4593 |
| 320 | V | D | A | V | A | E | L | A | R | 4 | 4594 |
| 324 | A | E | L | A | R | K | A | G | C | 4 | 4595 |
| 330 | A | G | C | K | L | T | I | C | P | 4 | 4596 |
| 334 | L | T | I | C | P | Q | A | E | N | 4 | 4597 |
| 341 | E | N | R | N | D | R | W | I | Q | 4 | 4598 |
| 348 | I | Q | D | E | M | E | L | G | Y | 4 | 4599 |
| 352 | M | E | L | G | Y | V | Q | A | P | 4 | 4600 |
| 353 | E | L | G | Y | V | Q | A | P | H | 4 | 4601 |
| 387 | P | D | F | G | Y | V | T | R | E | 4 | 4602 |
| 429 | L | I | G | G | N | L | P | G | S | 4 | 4603 |
| 431 | G | G | N | L | P | G | S | S | G | 4 | 4604 |
| 440 | R | R | V | T | Q | V | V | R | D | 4 | 4605 |
| 452 | A | Q | K | V | Q | P | P | V | E | 4 | 4606 |
| 473 | E | F | L | S | F | V | P | A | F | 4 | 4607 |
| 474 | F | L | S | F | V | P | A | D | 4 |   | 4608 |
| 475 | L | S | F | V | P | A | P | D | G | 4 | 4609 |
| 477 | F | V | P | A | P | D | G | K | G | 4 | 4610 |
| 484 | K | G | F | R | M | L | L | A | S | 4 | 4611 |
| 490 | L | A | S | P | G | A | C | F | K | 4 | 4612 |
| 493 | P | G | A | C | F | K | L | F | Q | 4 | 4613 |
| 495 | A | C | F | K | L | F | Q | E | K | 4 | 4614 |
| 507 | G | H | G | R | A | L | L | F | Q | 4 | 4615 |
| 525 | T | I | S | I | N | Q | V | L | S | 4 | 4616 |
| 526 | I | S | I | N | Q | V | L | S | N | 4 | 4617 |
| 531 | V | L | S | N | K | D | L | I | N | 4 | 4618 |
| 538 | I | N | Y | N | K | F | V | Q | S | 4 | 4619 |
| 578 | K | K | A | T | A | F | F | P | D | 4 | 4620 |
| 607 | I | N | G | C | C | C | L | E | E | 4 | 4621 |

TABLE XXVIII-continued

| Pos | 1 | 2 | 3 | 4 | 5 | 6 | 7 | 8 | 9 | score | SEQ. ID NO. |
|---|---|---|---|---|---|---|---|---|---|---|---|
| 620 | L | L | E | P | L | G | L | H | C | 4 | 4622 |
| 644 | V | H | C | G | T | N | V | C | R | 4 | 4623 |
| 5 | R | I | V | R | V | S | L | E | H | 3 | 4624 |
| 6 | I | V | R | V | S | L | E | H | P | 3 | 4625 |
| 11 | L | E | H | P | T | S | A | V | C | 3 | 4626 |
| 26 | L | V | D | I | Y | G | S | V | P | 3 | 4627 |
| 27 | V | D | I | Y | G | S | V | P | E | 3 | 4628 |
| 35 | E | G | T | E | M | F | E | V | Y | 3 | 4629 |
| 39 | M | F | E | V | Y | G | T | P | G | 3 | 4630 |
| 51 | Y | I | S | P | N | M | E | R | G | 3 | 4631 |
| 58 | R | G | R | E | R | A | D | T | R | 3 | 4632 |
| 61 | E | R | A | D | T | R | R | W | R | 3 | 4633 |
| 63 | A | D | T | R | R | W | R | F | D | 3 | 4634 |
| 73 | T | L | E | I | I | V | V | M | N | 3 | 4635 |
| 80 | M | N | S | P | S | N | D | L | N | 3 | 4636 |
| 96 | Y | H | S | S | H | E | P | L | P | 3 | 4637 |
| 117 | I | S | L | D | C | D | L | N | C | 3 | 4638 |
| 129 | Q | D | R | N | F | V | D | K | R | 3 | 4639 |
| 133 | F | V | D | K | R | Q | W | V | W | 3 | 4640 |
| 135 | D | K | R | Q | W | V | W | G | P | 3 | 4641 |
| 137 | R | Q | W | V | W | G | P | S | G | 3 | 4642 |
| 140 | V | W | G | P | S | G | Y | G | G | 3 | 4643 |
| 146 | Y | G | G | I | L | L | V | N | C | 3 | 4644 |
| 181 | S | V | M | V | L | R | T | Q | G | 3 | 4645 |
| 194 | F | D | D | H | K | L | V | L | H | 3 | 4646 |
| 202 | H | T | S | S | Y | D | A | K | R | 3 | 4647 |
| 207 | D | A | K | R | A | Q | V | F | H | 3 | 4648 |
| 209 | K | R | A | Q | V | F | H | I | C | 3 | 4649 |
| 223 | C | E | A | Y | R | H | V | L | G | 3 | 4650 |
| 228 | H | V | L | G | Q | D | K | V | S | 3 | 4651 |
| 229 | V | L | G | Q | D | K | V | S | Y | 3 | 4652 |
| 233 | D | K | V | S | Y | E | V | P | R | 3 | 4653 |
| 245 | D | E | E | R | F | F | V | E | G | 3 | 4654 |
| 250 | F | V | E | G | L | S | F | P | D | 3 | 4655 |
| 260 | G | F | T | G | L | I | S | F | H | 3 | 4656 |
| 288 | T | V | V | F | R | V | A | P | W | 3 | 4657 |
| 292 | R | V | A | P | W | I | M | T | P | 3 | 4658 |
| 317 | T | C | F | V | D | A | V | A | E | 3 | 4659 |
| 329 | K | A | G | C | K | L | T | I | C | 3 | 4660 |
| 350 | D | E | M | E | L | G | Y | V | Q | 3 | 4661 |
| 357 | V | Q | A | P | H | K | T | L | P | 3 | 4662 |
| 362 | K | T | L | P | V | V | F | D | S | 3 | 4663 |
| 372 | R | N | G | E | L | Q | D | F | P | 3 | 4664 |
| 394 | R | E | P | R | D | R | S | V | S | 3 | 4665 |
| 397 | R | D | R | S | V | S | G | L | D | 3 | 4666 |
| 405 | D | S | F | G | N | L | E | V | S | 3 | 4667 |
| 406 | S | F | G | N | L | E | V | S | P | 3 | 4668 |
| 412 | V | S | P | P | V | V | A | N | G | 3 | 4669 |
| 445 | V | V | R | D | F | L | H | A | Q | 3 | 4670 |
| 449 | F | L | H | A | Q | K | V | Q | P | 3 | 4671 |
| 450 | L | H | A | Q | K | V | Q | P | P | 3 | 4672 |
| 462 | F | V | D | W | L | A | V | G | H | 3 | 4673 |
| 464 | D | W | L | A | V | G | H | V | D | 3 | 4674 |
| 465 | W | L | A | V | G | H | V | D | E | 3 | 4675 |
| 485 | G | F | R | M | L | L | A | S | P | 3 | 4676 |
| 502 | E | K | Q | K | C | G | H | G | R | 3 | 4677 |
| 508 | H | G | R | A | L | L | F | Q | G | 3 | 4678 |
| 512 | L | L | F | Q | G | V | V | D | D | 3 | 4679 |
| 513 | L | F | Q | G | V | V | D | D | E | 3 | 4680 |
| 548 | I | D | W | N | R | E | V | L | K | 3 | 4681 |
| 549 | D | W | N | R | E | V | L | K | R | 3 | 4682 |
| 557 | R | E | L | G | L | A | E | C | D | 3 | 4683 |
| 563 | E | C | D | I | I | D | I | P | Q | 3 | 4684 |
| 577 | R | K | K | A | T | A | F | F | P | 3 | 4685 |
| 587 | L | V | N | M | L | V | L | G | K | 3 | 4686 |
| 606 | I | I | N | G | C | C | C | L | E | 3 | 4687 |
| 614 | E | E | K | V | R | S | L | L | E | 3 | 4688 |
| 615 | E | K | V | R | S | L | L | E | P | 3 | 4689 |
| 617 | V | R | S | L | L | E | P | L | G | 3 | 4690 |
| 619 | S | L | L | E | P | L | G | L | H | 3 | 4691 |
| 629 | T | F | I | D | D | F | T | P | Y | 3 | 4692 |
| 630 | F | I | D | D | F | T | P | Y | H | 3 | 4693 |
| 637 | Y | H | M | L | H | G | E | V | H | 3 | 4694 |
| 639 | M | L | H | G | E | V | H | C | G | 3 | 4695 |
| 643 | E | V | H | C | G | T | N | V | C | 3 | 4696 |
| 2 | S | L | Q | R | I | V | R | V | S | 2 | 4697 |
| 36 | G | T | E | M | F | E | V | Y | G | 2 | 4698 |
| 43 | Y | G | T | P | G | V | D | I | Y | 2 | 4699 |
| 47 | G | V | D | I | Y | I | S | P | N | 2 | 4700 |
| 54 | P | N | M | E | R | G | R | E | R | 2 | 4701 |
| 76 | I | I | V | V | M | N | S | P | S | 2 | 4702 |
| 77 | I | V | V | M | N | S | P | S | N | 2 | 4703 |
| 81 | N | S | P | S | N | D | L | N | D | 2 | 4704 |
| 87 | L | N | D | S | H | V | Q | I | S | 2 | 4705 |
| 88 | N | D | S | H | V | Q | I | S | Y | 2 | 4706 |
| 93 | Q | I | S | Y | H | S | S | H | E | 2 | 4707 |
| 113 | T | C | V | D | I | S | L | D | C | 2 | 4708 |
| 116 | D | I | S | L | D | C | D | L | N | 2 | 4709 |
| 124 | N | C | E | G | R | Q | D | R | N | 2 | 4710 |
| 134 | V | D | K | R | Q | W | V | W | G | 2 | 4711 |
| 136 | K | R | Q | W | V | W | G | P | S | 2 | 4712 |
| 153 | N | C | D | R | D | D | P | S | C | 2 | 4713 |
| 154 | C | D | R | D | D | P | S | C | D | 2 | 4714 |
| 157 | D | D | P | S | C | D | V | Q | D | 2 | 4715 |
| 165 | D | N | C | D | Q | H | V | H | C | 2 | 4716 |
| 168 | D | Q | H | V | H | C | L | Q | D | 2 | 4717 |
| 171 | V | H | C | L | Q | D | L | E | D | 2 | 4718 |
| 198 | K | L | V | L | H | T | S | S | Y | 2 | 4719 |
| 211 | A | Q | V | F | H | I | C | G | P | 2 | 4720 |
| 213 | V | F | H | I | C | G | P | E | D | 2 | 4721 |
| 219 | P | E | D | V | C | E | A | Y | R | 2 | 4722 |
| 244 | G | D | E | E | R | F | F | V | E | 2 | 4723 |
| 252 | E | G | L | S | F | P | D | A | G | 2 | 4724 |
| 266 | S | F | H | V | T | L | L | D | D | 2 | 4725 |
| 272 | L | D | D | S | N | E | D | F | S | 2 | 4726 |
| 274 | D | S | N | E | D | F | S | A | S | 2 | 4727 |
| 293 | V | A | P | W | I | M | T | P | S | 2 | 4728 |
| 310 | V | C | R | V | R | N | N | T | C | 2 | 4729 |
| 321 | D | A | V | A | E | L | A | R | K | 2 | 4730 |
| 323 | V | A | E | L | A | R | K | A | G | 2 | 4731 |
| 325 | E | L | A | R | K | A | G | C | K | 2 | 4732 |
| 333 | K | L | T | I | C | P | Q | A | E | 2 | 4733 |
| 338 | P | Q | A | E | N | R | N | D | R | 2 | 4734 |
| 343 | R | N | D | R | W | I | Q | D | E | 2 | 4735 |
| 374 | G | E | L | Q | D | F | P | Y | K | 2 | 4736 |
| 382 | K | R | I | L | G | P | D | F | G | 2 | 4737 |
| 388 | D | F | G | Y | V | T | R | E | P | 2 | 4738 |
| 389 | F | G | Y | V | T | R | E | P | R | 2 | 4739 |
| 403 | G | L | D | S | F | G | N | L | E | 2 | 4740 |
| 407 | F | G | N | L | E | V | S | P | P | 2 | 4741 |
| 415 | P | V | V | A | N | G | K | E | Y | 2 | 4742 |
| 419 | N | G | K | E | Y | P | L | G | R | 2 | 4743 |
| 425 | L | G | R | I | L | I | G | G | N | 2 | 4744 |
| 427 | R | I | L | I | G | G | N | L | P | 2 | 4745 |
| 430 | I | G | G | N | L | P | G | S | S | 2 | 4746 |
| 433 | N | L | P | G | S | S | G | R | R | 2 | 4747 |
| 446 | V | R | D | F | L | H | A | Q | K | 2 | 4748 |
| 461 | L | F | V | D | W | L | A | V | G | 2 | 4749 |
| 486 | F | R | M | L | L | A | S | P | G | 2 | 4750 |
| 488 | M | L | L | A | S | P | G | A | C | 2 | 4751 |
| 521 | R | Q | V | K | T | I | S | I | N | 2 | 4752 |
| 539 | N | Y | N | K | F | V | Q | S | C | 2 | 4753 |
| 544 | V | Q | S | C | I | D | W | N | R | 2 | 4754 |
| 550 | W | N | R | E | V | L | K | R | E | 2 | 4755 |
| 552 | R | E | V | L | K | R | E | L | G | 2 | 4756 |
| 556 | K | R | E | L | G | L | A | E | C | 2 | 4757 |
| 562 | A | E | C | D | I | I | D | I | P | 2 | 4758 |
| 586 | D | L | V | N | M | L | V | L | G | 2 | 4759 |
| 592 | V | L | G | K | H | L | G | I | P | 2 | 4760 |
| 593 | L | G | K | H | L | G | I | P | K | 2 | 4761 |
| 602 | P | F | G | P | I | I | N | G | C | 2 | 4762 |
| 611 | C | C | L | E | E | K | V | R | S | 2 | 4763 |
| 634 | F | T | P | Y | H | M | L | H | G | 2 | 4764 |
| 638 | H | M | L | H | G | E | V | H | C | 2 | 4765 |
| 645 | H | C | G | T | N | V | C | R | K | 2 | 4766 |
| 648 | T | N | V | C | R | K | P | F | S | 2 | 4767 |
| 652 | R | K | P | F | S | F | K | W | W | 2 | 4768 |
| 4 | Q | R | I | V | R | V | S | L | E | 1 | 4769 |
| 16 | S | A | V | C | V | A | G | V | E | 1 | 4770 |
| 22 | G | V | E | T | L | V | D | I | Y | 1 | 4771 |
| 24 | E | T | L | V | D | I | Y | G | S | 1 | 4772 |
| 38 | E | M | F | E | V | Y | G | T | P | 1 | 4773 |

TABLE XXVIII-continued

| Pos | 1 | 2 | 3 | 4 | 5 | 6 | 7 | 8 | 9 | score | SEQ. ID NO. |
|---|---|---|---|---|---|---|---|---|---|---|---|
| 52 | I | S | P | N | M | E | R | G | R | 1 | 4774 |
| 59 | G | R | E | R | A | D | T | R | R | 1 | 4775 |
| 74 | L | E | I | I | V | V | M | N | S | 1 | 4776 |
| 75 | E | I | I | V | V | M | N | S | P | 1 | 4777 |
| 78 | V | V | M | N | S | P | S | N | D | 1 | 4778 |
| 85 | N | D | L | N | D | S | H | V | Q | 1 | 4779 |
| 94 | I | S | Y | H | S | S | H | E | P | 1 | 4780 |
| 110 | L | Y | L | T | C | V | D | I | S | 1 | 4781 |
| 114 | C | V | D | I | S | L | D | C | D | 1 | 4782 |
| 118 | S | L | D | C | D | L | N | C | E | 1 | 4783 |
| 120 | D | C | D | L | N | C | E | G | R | 1 | 4784 |
| 122 | D | L | N | C | E | G | R | Q | D | 1 | 4785 |
| 123 | L | N | C | E | G | R | Q | D | R | 1 | 4786 |
| 127 | G | R | Q | D | R | N | F | V | D | 1 | 4787 |
| 131 | R | N | F | V | D | K | R | Q | W | 1 | 4788 |
| 147 | G | G | I | L | L | V | N | C | D | 1 | 4789 |
| 149 | I | L | L | V | N | C | D | R | D | 1 | 4790 |
| 151 | L | V | N | C | D | R | D | D | P | 1 | 4791 |
| 152 | V | N | C | D | R | D | D | P | S | 1 | 4792 |
| 160 | S | C | D | V | Q | D | N | C | D | 1 | 4793 |
| 164 | Q | D | N | C | D | Q | H | V | H | 1 | 4794 |
| 182 | V | M | V | L | R | T | Q | G | P | 1 | 4795 |
| 188 | Q | G | P | A | A | L | F | D | D | 1 | 4796 |
| 190 | P | A | A | L | F | D | D | H | K | 1 | 4797 |
| 197 | H | K | L | V | L | H | T | S | S | 1 | 4798 |
| 201 | L | H | T | S | S | Y | D | A | K | 1 | 4799 |
| 204 | S | S | Y | D | A | K | R | A | Q | 1 | 4800 |
| 210 | R | A | Q | V | F | H | I | C | G | 1 | 4801 |
| 212 | Q | V | F | H | I | C | G | P | E | 1 | 4802 |
| 220 | E | D | V | C | E | A | Y | R | H | 1 | 4803 |
| 226 | Y | R | H | V | L | G | Q | D | K | 1 | 4804 |
| 230 | L | G | Q | D | K | V | S | Y | E | 1 | 4805 |
| 232 | Q | D | K | V | S | Y | E | V | P | 1 | 4806 |
| 237 | Y | E | V | P | R | L | H | G | D | 1 | 4807 |
| 238 | E | V | P | R | L | H | G | D | E | 1 | 4808 |
| 247 | E | R | F | F | V | E | G | L | S | 1 | 4809 |
| 249 | F | F | V | E | G | L | S | F | P | 1 | 4810 |
| 255 | S | F | P | D | A | G | F | T | G | 1 | 4811 |
| 275 | S | N | E | D | F | S | A | S | P | 1 | 4812 |
| 306 | L | E | V | Y | V | C | R | V | R | 1 | 4813 |
| 308 | V | Y | V | C | R | V | R | N | N | 1 | 4814 |
| 313 | V | R | N | T | T | C | F | V | D | 1 | 4815 |
| 331 | G | C | K | L | T | I | C | P | Q | 1 | 4816 |
| 335 | T | I | C | P | Q | A | E | N | R | 1 | 4817 |
| 336 | I | C | P | Q | A | E | N | R | N | 1 | 4818 |
| 354 | L | G | Y | V | Q | A | P | H | K | 1 | 4819 |
| 363 | T | L | P | V | V | F | D | S | P | 1 | 4820 |
| 365 | P | V | V | F | D | S | P | R | N | 1 | 4821 |
| 369 | D | S | P | R | N | G | E | L | Q | 1 | 4822 |
| 373 | N | G | E | L | Q | D | F | P | Y | 1 | 4823 |
| 375 | E | L | Q | D | F | P | Y | K | R | 1 | 4824 |
| 378 | D | F | P | Y | K | R | I | L | G | 1 | 4825 |
| 380 | P | Y | K | R | I | L | G | P | D | 1 | 4826 |
| 390 | G | Y | V | T | R | E | P | R | D | 1 | 4827 |
| 401 | V | S | G | L | D | S | F | G | N | 1 | 4828 |
| 416 | V | V | A | N | G | K | E | Y | P | 1 | 4829 |
| 424 | P | L | G | R | I | L | I | G | G | 1 | 4830 |
| 432 | G | N | L | P | G | S | S | G | R | 1 | 4831 |
| 448 | D | F | L | H | A | Q | K | V | Q | 1 | 4832 |
| 471 | V | D | E | F | L | S | F | V | P | 1 | 4833 |
| 476 | S | F | V | P | A | P | D | G | K | 1 | 4834 |
| 479 | P | A | P | D | G | K | G | F | R | 1 | 4835 |
| 498 | K | L | F | Q | E | K | Q | K | C | 1 | 4836 |
| 500 | F | Q | E | K | Q | K | C | G | H | 1 | 4837 |
| 514 | F | Q | G | V | V | D | D | E | Q | 1 | 4838 |
| 516 | G | V | V | D | D | E | Q | V | K | 1 | 4839 |
| 519 | D | D | E | Q | V | K | T | I | S | 1 | 4840 |
| 528 | I | P | Q | V | L | S | N | K | D | 1 | 4841 |
| 532 | L | S | N | K | D | L | I | N | Y | 1 | 4842 |
| 534 | N | K | D | L | I | N | Y | N | K | 1 | 4843 |
| 537 | L | I | N | Y | N | K | F | V | Q | 1 | 4844 |
| 542 | K | F | V | Q | S | C | I | D | W | 1 | 4845 |
| 560 | G | L | A | E | C | D | I | S | D | 1 | 4846 |
| 568 | D | I | P | Q | L | F | K | T | E | 1 | 4847 |
| 570 | P | Q | L | F | K | T | E | R | K | 1 | 4848 |
| 571 | Q | L | F | K | T | E | R | K | K | 1 | 4849 |
| 588 | V | N | M | L | V | L | G | K | H | 1 | 4850 |
| 594 | G | K | H | L | G | I | P | K | P | 1 | 4851 |
| 597 | L | G | I | P | K | P | F | G | P | 1 | 4852 |
| 610 | C | C | C | L | E | E | K | V | R | 1 | 4853 |
| 624 | L | G | L | H | C | T | F | I | D | 1 | 4854 |
| 625 | G | L | H | C | T | F | I | D | D | 1 | 4855 |
| 633 | D | F | T | P | Y | H | M | L | H | 1 | 4856 |
| 651 | C | R | K | P | F | S | F | K | W | 1 | 4857 |
| 656 | S | F | K | W | W | N | M | V | P | 1 | 4858 |

184P1E2 v.2: HLA Peptide Scoring Results B 0702 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | A | P | L | E | V | Y | V | C | R | 14 | 4859 |
| 4 | T | P | S | T | L | A | P | L | E | 13 | 4860 |
| 3 | M | T | P | S | T | L | A | P | L | 12 | 4861 |
| 1 | W | I | M | T | P | S | T | L | A | 11 | 4862 |
| 7 | T | L | A | P | L | E | V | Y | V | 10 | 4863 |
| 5 | P | S | T | L | A | P | L | E | V | 8 | 4864 |
| 2 | I | M | T | P | S | T | L | A | P | 6 | 4865 |
| 6 | S | T | L | A | P | L | E | V | Y | 5 | 4866 |
| 8 | L | A | P | L | E | V | Y | V | C | 2 | 4867 |

184P1E2 v.3: HLA Peptide Scoring Results B 0702 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | V | P | D | G | K | G | F | R | M | 20 | 4868 |
| 7 | V | P | V | P | D | G | K | G | F | 18 | 4869 |
| 1 | D | E | F | L | S | F | V | P | V | 10 | 4870 |
| 3 | F | L | S | F | V | P | V | P | D | 5 | 4871 |
| 4 | L | S | F | V | P | V | P | D | G | 5 | 4872 |
| 2 | E | F | L | S | F | V | P | V | P | 4 | 4873 |
| 6 | F | V | P | V | P | D | G | K | G | 3 | 4874 |
| 5 | S | F | V | P | V | P | D | G | K | 1 | 4875 |
| 8 | P | V | P | D | G | K | G | F | R | 1 | 4876' |

TABLE XXIX

| Pos | 1 | 2 | 3 | 4 | 5 | 6 | 7 | 8 | 9 | score | SEQ. ID NO. |
|---|---|---|---|---|---|---|---|---|---|---|---|

184P1E2 v.1: HLA Peptide Scoring Results B08 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 612 | C | L | E | E | K | V | R | S | L | 29 | 4877 |
| 417 | V | A | N | G | K | E | Y | P | L | 25 | 4878 |
| 395 | E | P | R | D | R | S | V | S | G | 23 | 4879 |
| 575 | T | E | R | K | K | A | T | A | F | 23 | 4880 |
| 599 | I | P | K | P | F | G | P | I | I | 23 | 4881 |
| 368 | F | D | S | P | R | N | G | E | L | 21 | 4882 |
| 614 | E | E | K | V | R | S | L | L | E | 21 | 4883 |
| 326 | L | A | R | K | A | G | C | K | L | 20 | 4884 |
| 482 | D | G | K | G | F | R | M | L | L | 20 | 4885 |
| 501 | Q | E | K | Q | K | C | G | H | G | 20 | 4886 |
| 553 | E | V | L | K | R | E | L | G | L | 20 | 4887 |
| 246 | E | E | R | F | F | V | E | G | L | 19 | 4888 |
| 62 | R | A | D | T | R | W | R | W | F | 18 | 4889 |
| 104 | P | L | A | Y | A | V | L | Y | L | 18 | 4890 |
| 263 | G | L | I | S | F | H | V | T | L | 18 | 4891 |
| 325 | E | L | A | R | K | A | G | C | K | 18 | 4892 |
| 576 | E | R | K | K | A | T | A | F | F | 18 | 4893 |
| 3 | L | Q | R | I | V | R | A | V | S | L | 17 | 4894 |
| 102 | P | L | P | L | A | Y | A | V | L | 17 | 4895 |
| 142 | G | P | S | G | Y | G | G | I | L | 17 | 4896 |
| 256 | F | P | D | A | G | F | T | G | L | 17 | 4897 |
| 310 | V | C | R | V | R | N | N | T | C | 17 | 4898 |
| 360 | P | H | K | T | L | P | V | V | F | 17 | 4899 |
| 520 | D | E | Q | V | K | T | I | S | I | 17 | 4900 |
| 531 | V | L | S | N | K | D | L | I | N | 17 | 4901 |
| 554 | V | L | K | R | E | L | G | L | A | 17 | 4902 |
| 58 | R | G | R | E | R | A | D | T | R | 16 | 4903 |
| 111 | Y | L | T | C | V | D | I | S | L | 16 | 4904 |
| 379 | F | P | Y | K | R | I | L | G | P | 16 | 4905 |
| 480 | A | P | D | G | K | G | F | R | M | 16 | 4906 |
| 540 | Y | N | K | F | V | Q | S | C | I | 16 | 4907 |

TABLE XXIX-continued

| Pos | 1 | 2 | 3 | 4 | 5 | 6 | 7 | 8 | 9 | score | SEQ. ID NO. |
|---|---|---|---|---|---|---|---|---|---|---|---|
| 591 | L | V | L | G | K | H | L | G | I | 16 | 4908 |
| 616 | K | V | R | S | L | L | E | P | L | 16 | 4909 |
| 649 | N | V | C | R | K | P | F | S | F | 16 | 4910 |
| 56 | M | E | R | G | R | E | R | A | D | 15 | 4911 |
| 65 | T | R | R | W | R | F | D | A | T | 15 | 4912 |
| 109 | V | L | Y | L | T | C | V | D | I | 15 | 4913 |
| 207 | D | A | K | R | A | Q | V | F | H | 15 | 4914 |
| 239 | V | P | R | L | H | G | D | E | E | 15 | 4915 |
| 264 | L | I | S | F | H | V | T | L | L | 15 | 4916 |
| 423 | Y | P | L | G | R | I | L | I | G | 15 | 4917 |
| 492 | S | P | G | A | C | F | K | L | F | 15 | 4918 |
| 494 | G | A | C | F | K | L | F | Q | E | 15 | 4919 |
| 558 | E | L | G | L | A | E | C | D | I | 15 | 4920 |
| 184 | V | L | R | T | Q | G | P | A | A | 14 | 4921 |
| 191 | A | A | L | F | D | D | H | K | L | 14 | 4922 |
| 206 | Y | D | A | K | R | A | Q | V | F | 14 | 4923 |
| 329 | K | A | G | C | K | L | T | I | C | 14 | 4924 |
| 358 | Q | A | P | H | K | T | L | P | V | 14 | 4925 |
| 370 | S | P | R | N | G | E | L | Q | D | 14 | 4926 |
| 478 | V | P | A | P | D | G | K | G | F | 14 | 4927 |
| 506 | C | G | H | G | R | A | L | L | F | 14 | 4928 |
| 547 | C | I | D | W | N | R | E | V | L | 14 | 4929 |
| 579 | K | A | T | A | F | F | P | D | L | 14 | 4930 |
| 605 | P | I | I | N | G | C | C | C | L | 14 | 4931 |
| 622 | E | P | L | G | L | H | C | T | F | 14 | 4932 |
| 86 | D | L | N | D | S | H | V | Q | I | 13 | 4933 |
| 208 | A | K | R | A | Q | V | F | H | I | 13 | 4934 |
| 253 | G | L | S | F | P | D | A | G | F | 13 | 4935 |
| 271 | L | L | D | D | S | N | E | D | F | 13 | 4936 |
| 331 | G | C | K | L | T | I | C | P | Q | 13 | 4937 |
| 339 | Q | A | E | N | R | N | D | R | W | 13 | 4938 |
| 499 | L | F | Q | E | K | Q | K | C | G | 13 | 4939 |
| 529 | N | Q | V | L | S | N | K | D | L | 13 | 4940 |
| 533 | S | N | K | D | L | I | N | Y | N | 13 | 4941 |
| 573 | F | K | T | E | R | K | K | A | T | 13 | 4942 |
| 623 | P | L | G | L | H | C | T | F | I | 13 | 4943 |
| 656 | S | F | K | W | W | N | M | V | P | 13 | 4944 |
| 18 | V | C | V | A | G | V | E | T | L | 12 | 4945 |
| 95 | S | Y | H | S | S | H | E | P | L | 12 | 4946 |
| 134 | V | D | K | R | Q | W | V | W | G | 12 | 4947 |
| 194 | F | D | D | H | K | L | V | L | H | 12 | 4948 |
| 205 | S | Y | D | A | K | R | A | Q | V | 12 | 4949 |
| 234 | K | V | S | Y | E | V | P | R | L | 12 | 4950 |
| 241 | R | L | H | G | D | E | E | R | F | 12 | 4951 |
| 318 | C | F | V | D | A | V | A | E | L | 12 | 4952 |
| 381 | Y | K | R | I | L | G | P | D | F | 12 | 4953 |
| 402 | S | G | L | D | S | F | G | N | L | 12 | 4954 |
| 419 | N | G | K | E | Y | P | L | G | R | 12 | 4955 |
| 426 | G | R | I | L | I | G | G | N | L | 12 | 4956 |
| 442 | V | T | Q | V | V | R | D | F | L | 12 | 4957 |
| 453 | Q | K | V | Q | P | P | V | E | L | 12 | 4958 |
| 458 | P | V | E | F | V | D | W | L | L | 12 | 4959 |
| 466 | L | A | V | G | H | V | D | E | F | 12 | 4960 |
| 489 | L | L | A | S | P | G | A | C | F | 12 | 4961 |
| 538 | I | N | Y | N | K | F | V | Q | S | 12 | 4962 |
| 551 | N | R | E | V | L | K | R | E | L | 12 | 4963 |
| 583 | F | F | P | D | L | V | N | M | L | 12 | 4964 |
| 589 | N | M | L | V | L | G | K | H | L | 12 | 4965 |
| 54 | P | N | M | E | R | G | R | E | R | 11 | 4966 |
| 79 | V | M | N | S | P | S | N | D | L | 11 | 4967 |
| 97 | H | S | S | H | E | P | L | P | L | 11 | 4968 |
| 115 | V | D | I | S | L | D | C | D | L | 11 | 4969 |
| 143 | P | S | G | Y | G | G | I | L | L | 11 | 4970 |
| 166 | N | C | D | G | H | V | H | C | L | 11 | 4971 |
| 177 | L | E | D | M | S | V | M | V | L | 11 | 4972 |
| 185 | L | R | T | Q | G | P | A | A | L | 11 | 4973 |
| 196 | D | H | K | L | V | L | H | T | S | 11 | 4974 |
| 222 | V | C | E | A | Y | R | H | V | L | 11 | 4975 |
| 230 | L | G | Q | D | K | V | S | Y | E | 11 | 4976 |
| 232 | Q | D | K | V | S | Y | E | V | P | 11 | 4977 |
| 244 | G | D | E | E | R | F | F | V | E | 11 | 4978 |
| 283 | P | I | F | T | D | T | V | V | F | 11 | 4979 |
| 327 | A | R | K | A | G | C | K | L | T | 11 | 4980 |
| 346 | R | W | I | Q | D | E | M | E | L | 11 | 4981 |
| 356 | Y | V | Q | A | P | H | K | T | L | 11 | 4982 |
| 378 | D | F | P | Y | K | R | I | L | G | 11 | 4983 |
| 396 | P | R | D | R | S | V | S | G | L | 11 | 4984 |
| 437 | S | S | G | R | R | V | T | Q | V | 11 | 4985 |
| 450 | L | H | A | Q | K | V | Q | P | P | 11 | 4986 |
| 452 | A | Q | K | V | Q | P | P | V | E | 11 | 4987 |
| 496 | C | F | K | L | F | Q | E | K | Q | 11 | 4988 |
| 504 | Q | K | C | G | H | G | R | A | L | 11 | 4989 |
| 518 | V | D | D | E | Q | V | K | T | I | 11 | 4990 |
| 524 | K | T | I | S | I | N | Q | V | L | 11 | 4991 |
| 552 | R | E | V | L | K | R | E | L | G | 11 | 4992 |
| 561 | L | A | E | C | D | I | I | D | I | 11 | 4993 |
| 564 | C | D | I | I | D | I | P | Q | L | 11 | 4994 |
| 572 | L | F | K | T | E | R | K | K | A | 11 | 4995 |
| 585 | P | D | L | V | N | M | L | V | L | 11 | 4996 |
| 598 | G | I | P | K | F | G | P | I | I | 11 | 4997 |
| 618 | R | S | L | L | E | P | L | G | L | 11 | 4998 |
| 1 | M | S | L | Q | R | I | V | R | V | 10 | 4999 |
| 4 | Q | R | I | V | R | V | S | L | E | 10 | 5000 |
| 32 | S | V | P | E | G | T | E | M | F | 10 | 5001 |
| 66 | R | R | W | R | F | D | A | T | L | 10 | 5002 |
| 127 | G | R | Q | D | R | N | F | V | D | 10 | 5003 |
| 132 | N | F | V | D | K | R | Q | W | V | 10 | 5004 |
| 169 | Q | H | V | H | C | L | Q | D | L | 10 | 5005 |
| 182 | V | M | V | L | R | T | Q | G | P | 10 | 5006 |
| 193 | L | F | D | D | H | K | L | V | L | 10 | 5007 |
| 223 | C | E | A | Y | R | H | V | L | G | 10 | 5008 |
| 295 | P | W | I | M | T | P | S | T | L | 10 | 5009 |
| 298 | M | T | P | S | T | L | P | P | L | 10 | 5010 |
| 308 | V | Y | V | C | R | V | R | N | N | 10 | 5011 |
| 377 | Q | D | F | P | Y | K | R | I | L | 10 | 5012 |
| 380 | P | Y | K | R | I | L | G | P | D | 10 | 5013 |
| 421 | K | E | Y | P | L | G | R | I | L | 10 | 5014 |
| 436 | G | S | S | G | R | R | V | T | Q | 10 | 5015 |
| 460 | E | L | F | V | D | W | L | A | V | 10 | 5016 |
| 467 | A | V | G | H | V | D | E | F | L | 10 | 5017 |
| 481 | P | D | G | K | G | F | R | M | L | 10 | 5018 |
| 491 | A | S | P | G | A | C | F | K | L | 10 | 5019 |
| 503 | K | Q | K | C | G | H | G | R | A | 10 | 5020 |
| 505 | K | C | G | H | G | R | A | L | L | 10 | 5021 |
| 522 | Q | V | K | T | I | S | I | N | Q | 10 | 5022 |
| 548 | I | D | W | N | R | E | V | L | K | 10 | 5023 |
| 565 | D | I | I | D | I | P | Q | L | F | 10 | 5024 |
| 570 | P | Q | L | F | K | T | E | R | K | 10 | 5025 |
| 574 | K | T | E | R | K | K | A | T | A | 10 | 5026 |
| 577 | R | K | K | A | T | A | F | F | P | 10 | 5027 |
| 593 | L | G | K | H | L | G | I | P | K | 10 | 5028 |
| 597 | L | G | I | P | K | F | G | P | P | 10 | 5029 |
| 613 | L | E | E | K | V | R | S | L | L | 10 | 5030 |
| 619 | S | L | L | E | P | L | G | L | H | 10 | 5031 |
| 632 | D | D | F | T | P | Y | H | M | L | 10 | 5032 |
| 651 | C | R | K | P | F | S | F | K | W | 10 | 5033 |
| 654 | P | F | S | F | K | W | W | N | M | 10 | 5034 |
| 2 | S | L | Q | R | I | V | R | V | S | 9 | 5035 |
| 10 | S | L | E | H | P | T | S | A | V | 9 | 5036 |
| 21 | A | G | V | E | T | L | V | D | I | 9 | 5037 |
| 101 | E | P | L | P | L | A | Y | A | V | 9 | 5038 |
| 133 | F | V | D | K | R | Q | W | V | W | 9 | 5039 |
| 152 | V | N | C | D | R | D | D | P | S | 9 | 5040 |
| 288 | T | V | V | F | R | V | A | P | W | 9 | 5041 |
| 304 | P | P | L | E | V | Y | V | C | R | 9 | 5042 |
| 353 | E | L | G | Y | V | Q | A | P | H | 9 | 5043 |
| 390 | G | Y | V | T | R | E | P | R | D | 9 | 5044 |
| 392 | V | T | R | E | P | R | D | R | S | 9 | 5045 |
| 413 | S | P | P | V | V | A | N | G | K | 9 | 5046 |
| 422 | E | Y | P | L | G | R | I | L | I | 9 | 5047 |
| 439 | G | R | R | V | T | Q | V | V | R | 9 | 5048 |
| 443 | T | Q | V | V | R | D | F | L | H | 9 | 5049 |
| 457 | P | P | V | E | L | F | V | D | W | 9 | 5050 |
| 483 | G | K | G | F | R | M | L | A | A | 9 | 5051 |
| 550 | W | N | R | E | V | L | K | R | E | 9 | 5052 |
| 555 | L | K | R | E | L | G | L | A | E | 9 | 5053 |
| 560 | G | L | A | E | C | D | I | I | D | 9 | 5054 |
| 569 | I | P | Q | L | F | K | T | E | R | 9 | 5055 |
| 584 | F | P | D | L | V | N | M | L | V | 9 | 5056 |
| 647 | G | T | N | V | C | R | K | P | F | 9 | 5057 |
| 6 | I | V | R | V | S | L | E | H | P | 8 | 5058 |
| 13 | H | P | T | S | A | V | C | V | A | 8 | 5059 |

TABLE XXIX-continued

| Pos | 1 | 2 | 3 | 4 | 5 | 6 | 7 | 8 | 9 | score | SEQ. ID NO. |
|---|---|---|---|---|---|---|---|---|---|---|---|
| 42 | V | Y | G | T | P | G | V | D | I | 8 | 5060 |
| 45 | T | P | G | V | D | I | Y | I | S | 8 | 5061 |
| 53 | S | P | N | M | E | R | G | R | E | 8 | 5062 |
| 63 | A | D | T | R | R | W | R | F | D | 8 | 5063 |
| 73 | T | L | E | I | I | V | V | M | N | 8 | 5064 |
| 82 | S | P | S | N | D | L | N | D | S | 8 | 5065 |
| 118 | S | L | D | C | D | L | N | C | E | 8 | 5066 |
| 124 | N | C | E | G | R | Q | D | R | N | 8 | 5067 |
| 126 | E | G | R | Q | D | R | N | F | V | 8 | 5068 |
| 149 | I | L | L | V | N | C | D | R | D | 8 | 5069 |
| 218 | G | P | E | D | V | C | E | A | Y | 8 | 5070 |
| 229 | V | L | G | Q | D | K | V | S | Y | 8 | 5071 |
| 237 | Y | E | V | P | R | L | H | G | D | 8 | 5072 |
| 277 | E | D | F | S | A | S | P | I | F | 8 | 5073 |
| 282 | S | P | I | F | T | D | T | V | V | 8 | 5074 |
| 290 | V | R | F | V | A | P | W | I | M | 8 | 5075 |
| 303 | L | P | P | L | E | V | Y | V | C | 8 | 5076 |
| 305 | P | L | E | V | Y | V | C | R | V | 8 | 5077 |
| 323 | V | A | E | L | A | R | K | A | G | 8 | 5078 |
| 324 | A | E | L | A | R | K | A | G | C | 8 | 5079 |
| 341 | E | N | R | N | D | R | W | I | Q | 8 | 5080 |
| 342 | N | R | N | D | R | W | I | Q | D | 8 | 5081 |
| 375 | E | L | Q | D | F | P | Y | K | R | 8 | 5082 |
| 386 | G | P | D | F | G | Y | V | T | R | 8 | 5083 |
| 393 | T | R | E | P | R | D | R | S | V | 8 | 5084 |
| 414 | P | P | V | V | A | N | G | K | E | 8 | 5085 |
| 420 | G | K | E | Y | P | L | G | R | I | 8 | 5086 |
| 428 | I | L | I | G | G | N | L | P | G | 8 | 5087 |
| 438 | S | G | R | R | V | T | Q | V | V | 8 | 5088 |
| 445 | V | V | R | D | F | L | H | A | Q | 8 | 5089 |
| 449 | F | L | H | A | Q | K | V | Q | P | 8 | 5090 |
| 465 | W | L | A | V | G | H | V | D | E | 8 | 5091 |
| 512 | L | L | F | Q | G | V | V | D | D | 8 | 5092 |
| 536 | D | L | I | N | Y | N | K | F | V | 8 | 5093 |
| 648 | T | N | V | C | R | K | P | F | S | 8 | 5094 |
| 33 | V | P | E | G | T | E | M | F | E | 7 | 5095 |
| 4 | G | T | P | G | V | D | I | Y | I | 7 | 5096 |
| 68 | W | R | F | D | A | T | L | E | I | 7 | 5097 |
| 75 | E | I | I | V | V | M | N | S | P | 7 | 5098 |
| 76 | I | I | V | V | M | N | S | P | S | 7 | 5099 |
| 103 | L | P | L | A | Y | A | V | L | Y | 7 | 5100 |
| 129 | Q | D | R | N | F | V | D | K | R | 7 | 5101 |
| 135 | D | K | R | Q | W | V | W | G | P | 7 | 5102 |
| 148 | G | I | L | L | V | N | C | D | R | 7 | 5103 |
| 158 | D | P | S | C | D | V | Q | D | N | 7 | 5104 |
| 176 | D | L | E | D | M | S | V | M | V | 7 | 5105 |
| 189 | G | P | E | A | A | L | F | D | D | 7 | 5106 |
| 192 | A | L | F | D | D | H | K | L | V | 7 | 5107 |
| 198 | K | L | V | L | H | T | S | S | Y | 7 | 5108 |
| 200 | V | L | H | T | S | S | Y | D | A | 7 | 5109 |
| 224 | E | A | Y | R | H | V | L | G | Q | 7 | 5110 |
| 248 | R | F | F | V | E | G | L | S | F | 7 | 5111 |
| 270 | T | L | L | D | D | S | N | E | D | 7 | 5112 |
| 289 | V | V | F | R | V | A | P | W | I | 7 | 5113 |
| 302 | T | L | P | P | L | E | V | Y | V | 7 | 5114 |
| 311 | C | R | V | R | N | N | T | C | F | 7 | 5115 |
| 333 | K | L | T | I | C | P | Q | A | E | 7 | 5116 |
| 337 | C | P | Q | A | E | N | R | N | D | 7 | 5117 |
| 344 | N | D | R | W | I | Q | D | E | M | 7 | 5118 |
| 363 | T | L | P | V | V | F | D | S | P | 7 | 5119 |
| 364 | L | P | V | V | F | D | S | P | R | 7 | 5120 |
| 376 | L | Q | D | F | P | Y | K | R | I | 7 | 5121 |
| 384 | I | L | G | P | D | F | G | Y | V | 7 | 5122 |
| 403 | G | L | D | S | F | G | N | L | E | 7 | 5123 |
| 409 | N | L | E | V | S | P | P | V | V | 7 | 5124 |
| 425 | L | G | R | I | L | I | G | G | N | 7 | 5125 |
| 441 | R | V | T | Q | V | V | R | D | F | 7 | 5126 |
| 454 | K | V | Q | P | P | V | E | L | F | 7 | 5127 |
| 456 | Q | P | P | V | E | L | F | V | D | 7 | 5128 |
| 469 | G | H | V | D | E | F | L | S | F | 7 | 5129 |
| 474 | F | L | S | F | V | P | A | P | D | 7 | 5130 |
| 485 | G | F | R | M | L | L | A | S | P | 7 | 5131 |
| 488 | M | L | L | A | S | P | G | A | C | 7 | 5132 |
| 508 | H | G | R | A | L | L | F | Q | G | 7 | 5133 |
| 511 | A | L | L | F | Q | G | V | V | D | 7 | 5134 |
| 586 | D | L | V | N | M | L | V | L | G | 7 | 5135 |
| 590 | M | L | V | L | G | K | H | L | G | 7 | 5136 |
| 592 | V | L | G | K | H | L | G | I | P | 7 | 5137 |
| 595 | K | H | L | G | I | P | K | P | F | 7 | 5138 |
| 596 | H | L | G | I | P | K | P | F | G | 7 | 5139 |
| 601 | K | P | F | G | P | I | I | N | G | 7 | 5140 |
| 604 | G | P | I | I | N | G | C | C | C | 7 | 5141 |
| 625 | G | L | H | C | T | F | I | D | D | 7 | 5142 |
| 626 | L | H | C | T | F | I | D | D | F | 7 | 5143 |
| 639 | M | L | H | G | E | V | H | C | G | 7 | 5144 |
| 650 | V | C | R | K | P | F | S | F | K | 7 | 5145 |
| 16 | S | A | V | C | V | A | G | V | E | 6 | 5146 |
| 20 | V | A | G | V | E | T | L | V | D | 6 | 5147 |
| 25 | T | L | V | D | I | Y | G | S | V | 6 | 5148 |
| 28 | D | I | Y | G | S | V | P | E | G | 6 | 5149 |
| 60 | R | E | R | A | D | T | R | R | W | 6 | 5150 |
| 64 | D | T | R | R | W | R | F | D | A | 6 | 5151 |
| 67 | R | W | R | F | D | A | T | L | E | 6 | 5152 |
| 69 | R | F | D | A | T | L | E | I | I | 6 | 5153 |
| 71 | D | A | T | L | E | I | I | V | V | 6 | 5154 |
| 122 | D | L | N | C | E | G | R | Q | D | 6 | 5155 |
| 125 | C | E | G | R | Q | D | R | N | F | 6 | 5156 |
| 141 | W | G | P | S | G | Y | G | G | I | 6 | 5157 |
| 150 | L | L | V | N | C | D | R | D | D | 6 | 5158 |
| 154 | C | D | R | D | D | P | S | C | D | 6 | 5159 |
| 173 | C | L | Q | D | L | E | D | M | S | 6 | 5160 |
| 186 | R | T | Q | G | P | A | A | L | F | 6 | 5161 |
| 225 | A | Y | R | H | V | L | G | Q | D | 6 | 5162 |
| 242 | L | H | G | D | E | E | R | F | F | 6 | 5163 |
| 257 | P | D | A | G | F | T | G | L | I | 6 | 5164 |
| 259 | A | G | F | T | G | L | I | S | F | 6 | 5165 |
| 276 | N | E | D | F | S | A | S | P | I | 6 | 5166 |
| 280 | S | A | S | P | I | F | T | D | T | 6 | 5167 |
| 294 | A | P | W | I | M | T | P | S | T | 6 | 5168 |
| 299 | T | P | S | T | L | P | P | L | E | 6 | 5169 |
| 312 | R | V | R | N | N | T | C | F | V | 6 | 5170 |
| 328 | R | K | A | G | C | K | L | T | I | 6 | 5171 |
| 340 | A | E | N | R | N | D | R | W | I | 6 | 5172 |
| 359 | R | H | K | T | L | P | V | V | F | 6 | 5173 |
| 371 | P | R | N | G | E | L | Q | D | F | 6 | 5174 |
| 397 | R | D | R | S | V | S | G | L | D | 6 | 5175 |
| 399 | R | S | V | S | G | L | D | S | F | 6 | 5176 |
| 424 | P | L | G | R | I | L | I | G | G | 6 | 5177 |
| 433 | N | L | P | G | S | S | G | R | R | 6 | 5178 |
| 434 | L | P | G | S | S | G | R | R | V | 6 | 5179 |
| 498 | K | L | F | Q | E | K | Q | K | C | 6 | 5180 |
| 527 | S | I | N | Q | V | L | S | N | K | 6 | 5181 |
| 530 | Q | V | L | S | N | K | D | L | I | 6 | 5182 |
| 535 | K | D | L | I | N | Y | N | K | F | 6 | 5183 |
| 559 | L | G | L | A | E | C | D | I | I | 6 | 5184 |
| 571 | Q | L | F | K | T | E | R | K | K | 6 | 5185 |
| 620 | L | L | E | P | L | G | L | H | C | 6 | 5186 |
| 635 | T | P | Y | H | M | L | H | G | E | 6 | 5187 |
| 653 | K | P | F | S | F | K | W | W | N | 6 | 5188 |
| 5 | R | I | V | R | V | S | L | E | H | 5 | 5189 |
| 93 | Q | I | S | Y | H | S | S | H | E | 5 | 5190 |
| 107 | Y | A | V | L | Y | L | T | C | V | 5 | 5191 |
| 116 | D | I | S | L | D | C | D | L | N | 5 | 5192 |
| 190 | P | A | A | L | F | D | D | H | K | 5 | 5193 |
| 210 | R | A | Q | V | F | H | I | C | G | 5 | 5194 |
| 215 | H | I | C | G | P | E | D | V | C | 5 | 5195 |
| 293 | V | A | P | W | I | M | T | P | S | 5 | 5196 |
| 411 | E | V | S | P | P | V | V | A | N | 5 | 5197 |
| 451 | H | A | Q | K | V | Q | P | P | V | 5 | 5198 |
| 510 | R | A | L | L | F | Q | G | V | V | 5 | 5199 |
| 525 | T | I | S | I | N | Q | V | L | S | 5 | 5200 |
| 537 | L | I | N | Y | N | K | F | V | Q | 5 | 5201 |
| 566 | I | I | D | I | P | Q | L | F | K | 5 | 5202 |
| 568 | D | I | P | Q | L | F | K | T | E | 5 | 5203 |
| 606 | I | I | N | G | C | C | C | L | E | 5 | 5204 |
| 630 | F | I | D | D | F | T | P | Y | H | 5 | 5205 |
| 24 | E | T | L | V | D | I | Y | G | S | 4 | 5206 |
| 35 | E | G | T | E | M | F | E | V | Y | 4 | 5207 |
| 38 | E | M | F | E | V | Y | G | T | P | 4 | 5208 |
| 49 | D | I | Y | I | S | P | N | M | E | 4 | 5209 |
| 51 | Y | I | S | P | N | M | E | R | G | 4 | 5210 |
| 72 | A | T | L | E | I | I | V | V | M | 4 | 5211 |

TABLE XXIX-continued

| Pos | 1 | 2 | 3 | 4 | 5 | 6 | 7 | 8 | 9 | score | SEQ. ID NO. |
|---|---|---|---|---|---|---|---|---|---|---|---|
| 98 | S | S | H | E | P | L | P | L | A | 4 | 5212 |
| 105 | L | A | Y | A | V | L | Y | L | T | 4 | 5213 |
| 217 | C | G | P | E | D | V | C | E | A | 4 | 5214 |
| 258 | D | A | G | F | T | G | L | I | S | 4 | 5215 |
| 296 | W | I | M | T | P | S | T | L | P | 4 | 5216 |
| 307 | E | V | Y | V | C | R | V | R | N | 4 | 5217 |
| 321 | D | A | V | A | E | L | A | R | K | 4 | 5218 |
| 335 | T | I | C | P | Q | A | E | N | R | 4 | 5219 |
| 347 | W | I | Q | D | E | M | E | L | G | 4 | 5220 |
| 351 | E | M | E | L | G | Y | V | Q | A | 4 | 5221 |
| 361 | H | K | T | L | P | V | V | F | D | 4 | 5222 |
| 383 | R | I | L | G | P | D | F | G | Y | 4 | 5223 |
| 427 | R | I | L | I | G | G | N | L | P | 4 | 5224 |
| 429 | L | I | G | G | N | L | P | G | S | 4 | 5225 |
| 473 | E | F | L | S | F | V | P | A | P | 4 | 5226 |
| 479 | P | A | P | D | G | K | G | F | R | 4 | 5227 |
| 490 | L | A | S | P | G | A | C | F | K | 4 | 5228 |
| 546 | S | C | I | D | W | N | R | E | V | 4 | 5229 |
| 581 | T | A | F | F | P | D | L | V | N | 4 | 5230 |
| 9 | V | S | L | E | H | P | T | S | A | 3 | 5231 |
| 12 | E | H | P | T | S | A | V | C | V | 3 | 5232 |
| 17 | A | V | C | V | A | G | V | E | T | 3 | 5233 |
| 27 | V | D | I | Y | G | S | V | P | E | 3 | 5234 |
| 50 | I | Y | I | S | P | N | M | E | R | 3 | 5235 |
| 84 | S | N | D | L | N | D | S | H | V | 3 | 5236 |
| 99 | S | H | E | P | L | P | L | A | Y | 3 | 5237 |
| 144 | S | G | Y | G | G | I | L | L | V | 3 | 5238 |
| 147 | G | G | I | L | L | V | N | C | D | 3 | 5239 |
| 160 | S | C | D | V | Q | D | N | C | D | 3 | 5240 |
| 171 | V | H | C | L | Q | D | L | E | D | 3 | 5241 |
| 178 | E | D | M | S | V | M | V | L | R | 3 | 5242 |
| 181 | S | V | M | V | L | R | T | Q | G | 3 | 5243 |
| 204 | S | S | Y | D | A | K | R | A | Q | 3 | 5244 |
| 235 | V | S | Y | E | V | P | R | L | H | 3 | 5245 |
| 236 | S | Y | E | V | P | R | L | H | G | 3 | 5246 |
| 243 | H | G | D | E | E | R | F | F | V | 3 | 5247 |
| 249 | F | F | V | E | G | L | S | F | P | 3 | 5248 |
| 252 | E | G | L | S | F | P | D | A | G | 3 | 5249 |
| 266 | S | F | H | V | T | L | L | D | D | 3 | 5250 |
| 274 | D | S | N | E | D | F | S | A | S | 3 | 5251 |
| 284 | I | F | T | D | T | V | V | F | R | 3 | 5252 |
| 287 | D | T | V | V | F | R | V | A | P | 3 | 5253 |
| 317 | T | C | F | V | D | A | V | A | E | 3 | 5254 |
| 320 | V | D | A | V | A | E | L | A | R | 3 | 5255 |
| 348 | I | Q | D | E | M | E | L | G | Y | 3 | 5256 |
| 406 | S | F | G | N | L | E | V | S | P | 3 | 5257 |
| 407 | F | G | N | L | E | V | S | P | P | 3 | 5258 |
| 408 | G | N | L | E | V | S | P | P | V | 3 | 5259 |
| 463 | V | D | W | L | A | V | G | H | V | 3 | 5260 |
| 470 | H | V | D | E | F | L | S | F | V | 3 | 5261 |
| 514 | F | Q | G | V | V | D | D | E | Q | 3 | 5262 |
| 521 | E | Q | V | K | T | I | S | I | N | 3 | 5263 |
| 594 | G | K | H | L | G | I | P | K | P | 3 | 5264 |
| 611 | C | C | L | E | E | K | V | R | S | 3 | 5265 |
| 615 | E | K | V | R | S | L | L | E | P | 3 | 5266 |
| 644 | V | H | C | G | T | N | V | C | R | 3 | 5267 |
| 14 | P | T | S | A | V | C | V | A | G | 2 | 5268 |
| 15 | T | S | A | V | C | V | A | G | V | 2 | 5269 |
| 22 | G | V | E | T | L | V | D | I | Y | 2 | 5270 |
| 23 | V | E | T | L | V | D | I | Y | G | 2 | 5271 |
| 31 | G | S | V | P | E | G | T | E | M | 2 | 5272 |
| 36 | G | T | E | M | F | E | V | Y | G | 2 | 5273 |
| 40 | F | E | V | Y | G | T | P | G | V | 2 | 5274 |
| 41 | E | V | Y | G | T | P | G | V | D | 2 | 5275 |
| 47 | G | V | D | I | Y | I | S | P | N | 2 | 5276 |
| 48 | V | D | I | Y | I | S | P | N | M | 2 | 5277 |
| 57 | E | R | G | R | E | R | A | D | T | 2 | 5278 |
| 61 | E | R | A | D | T | R | R | W | R | 2 | 5279 |
| 89 | D | S | H | V | Q | I | S | Y | H | 2 | 5280 |
| 90 | S | H | V | Q | I | S | Y | H | S | 2 | 5281 |
| 94 | I | S | Y | H | S | S | H | E | P | 2 | 5282 |
| 100 | H | E | P | L | P | L | A | Y | A | 2 | 5283 |
| 112 | L | T | C | V | D | I | S | L | D | 2 | 5284 |
| 119 | L | D | C | D | L | N | C | E | G | 2 | 5285 |
| 123 | L | N | C | E | G | R | Q | D | R | 2 | 5286 |
| 175 | Q | D | L | E | D | M | S | V | M | 2 | 5287 |
| 179 | D | M | S | V | M | V | L | R | T | 2 | 5288 |
| 197 | H | K | L | V | L | H | T | S | S | 2 | 5289 |
| 203 | T | S | S | Y | D | A | K | R | A | 2 | 5290 |
| 213 | V | F | H | I | C | G | P | E | D | 2 | 5291 |
| 216 | I | C | G | P | E | D | V | C | E | 2 | 5292 |
| 220 | E | D | V | C | E | A | Y | R | H | 2 | 5293 |
| 221 | D | V | C | E | A | Y | R | H | V | 2 | 5294 |
| 228 | H | V | L | G | Q | D | K | V | S | 2 | 5295 |
| 231 | G | Q | D | K | V | S | Y | E | V | 2 | 5296 |
| 238 | E | V | P | R | L | H | G | D | E | 2 | 5297 |
| 245 | D | E | E | R | F | F | V | E | G | 2 | 5298 |
| 247 | E | R | F | F | V | E | G | L | S | 2 | 5299 |
| 251 | V | E | G | L | S | F | P | D | A | 2 | 5300 |
| 255 | S | F | P | D | A | G | F | T | G | 2 | 5301 |
| 260 | G | F | T | G | L | I | S | F | H | 2 | 5302 |
| 261 | F | T | G | L | I | S | F | H | V | 2 | 5303 |
| 268 | H | V | T | L | L | D | D | S | N | 2 | 5304 |
| 269 | V | T | L | L | D | D | S | N | E | 2 | 5305 |
| 275 | S | N | E | D | F | S | A | S | P | 2 | 5306 |
| 279 | F | S | A | S | P | I | F | T | D | 2 | 5307 |
| 285 | F | T | D | T | V | V | F | R | V | 2 | 5308 |
| 300 | P | S | T | L | P | P | L | E | V | 2 | 5309 |
| 301 | S | T | L | P | P | L | E | V | Y | 2 | 5310 |
| 315 | N | N | T | C | F | V | D | A | V | 2 | 5311 |
| 322 | A | V | A | E | L | A | R | K | A | 2 | 5312 |
| 338 | P | Q | A | E | N | R | N | D | R | 2 | 5313 |
| 350 | D | E | M | E | L | G | Y | V | Q | 2 | 5314 |
| 352 | M | E | L | G | Y | V | Q | A | P | 2 | 5315 |
| 372 | R | N | G | E | L | Q | D | F | P | 2 | 5316 |
| 388 | D | F | G | Y | V | T | R | E | P | 2 | 5317 |
| 389 | F | G | Y | V | T | R | E | P | R | 2 | 5318 |
| 400 | S | V | S | G | L | D | S | F | G | 2 | 5319 |
| 401 | V | S | G | L | D | S | F | G | N | 2 | 5320 |
| 404 | L | D | S | F | G | N | L | E | V | 2 | 5321 |
| 412 | V | S | P | P | V | A | N | G | 2 | 5322 |
| 415 | P | V | V | A | N | G | K | E | Y | 2 | 5323 |
| 431 | G | G | N | L | P | G | S | S | G | 2 | 5324 |
| 440 | R | R | V | T | Q | V | V | R | D | 2 | 5325 |
| 462 | F | V | D | W | L | A | V | G | H | 2 | 5326 |
| 468 | V | G | H | V | D | E | F | L | S | 2 | 5327 |
| 472 | D | E | F | L | S | F | V | P | A | 2 | 5328 |
| 476 | S | F | V | P | A | P | D | G | K | 2 | 5329 |
| 486 | F | R | M | L | L | A | S | P | G | 2 | 5330 |
| 497 | F | K | L | F | Q | E | K | Q | K | 2 | 5331 |
| 502 | E | K | Q | K | C | G | H | G | R | 2 | 5332 |
| 509 | G | R | A | L | L | F | Q | G | V | 2 | 5333 |
| 517 | V | V | D | D | E | Q | V | K | T | 2 | 5334 |
| 523 | V | K | T | I | S | I | N | Q | V | 2 | 5335 |
| 526 | I | S | I | N | Q | V | L | S | N | 2 | 5336 |
| 528 | I | N | Q | V | L | S | N | K | D | 2 | 5337 |
| 534 | N | K | D | L | I | N | Y | N | K | 2 | 5338 |
| 543 | F | V | Q | S | C | I | D | W | N | 2 | 5339 |
| 556 | K | R | E | L | G | L | A | E | C | 2 | 5340 |
| 563 | E | C | D | I | I | D | I | P | Q | 2 | 5341 |
| 588 | V | N | M | L | V | L | G | K | H | 2 | 5342 |
| 603 | F | G | P | I | I | N | G | C | C | 2 | 5343 |
| 607 | I | N | G | C | C | L | E | E | 2 | 5344 |
| 610 | C | C | C | L | E | E | K | V | R | 2 | 5345 |
| 617 | V | R | S | L | L | E | P | G | L | 2 | 5346 |
| 634 | F | T | P | Y | H | M | L | H | G | 2 | 5347 |
| 638 | H | M | L | H | G | E | V | H | C | 2 | 5348 |
| 640 | L | H | G | E | V | H | C | G | T | 2 | 5349 |
| 641 | H | G | E | V | H | C | G | T | N | 2 | 5350 |
| 643 | E | V | H | C | G | T | N | V | C | 2 | 5351 |
| 645 | H | C | G | T | N | V | C | R | K | 2 | 5352 |
| 7 | V | R | V | S | L | E | H | P | T | 1 | 5353 |
| 8 | R | V | S | L | E | H | P | T | S | 1 | 5354 |
| 29 | I | Y | G | S | V | P | E | G | T | 1 | 5355 |
| 30 | Y | G | S | V | P | E | G | T | E | 1 | 5356 |
| 34 | P | E | G | T | E | M | F | E | V | 1 | 5357 |
| 37 | T | E | M | F | E | V | Y | G | T | 1 | 5358 |
| 39 | M | F | E | V | Y | G | T | P | G | 1 | 5359 |
| 43 | Y | G | T | P | G | V | D | I | Y | 1 | 5360 |
| 52 | I | S | P | N | M | E | R | G | R | 1 | 5361 |
| 59 | G | R | E | R | A | D | T | R | R | 1 | 5362 |
| 70 | F | D | A | T | L | E | I | I | V | 1 | 5363 |

TABLE XXIX-continued

| Pos | 1 | 2 | 3 | 4 | 5 | 6 | 7 | 8 | 9 | score | SEQ. ID NO. |
|---|---|---|---|---|---|---|---|---|---|---|---|
| 74 | L | E | I | I | V | V | M | N | S | 1 | 5364 |
| 77 | I | V | V | M | N | S | P | S | N | 1 | 5365 |
| 78 | V | V | M | N | S | P | S | N | D | 1 | 5366 |
| 80 | M | N | S | P | S | N | D | L | N | 1 | 5367 |
| 83 | P | S | N | D | L | N | D | S | H | 1 | 5368 |
| 87 | L | N | D | S | H | V | Q | I | S | 1 | 5369 |
| 91 | H | V | Q | I | S | Y | H | S | S | 1 | 5370 |
| 92 | V | Q | I | S | Y | H | S | S | H | 1 | 5371 |
| 106 | A | Y | A | V | L | Y | L | T | C | 1 | 5372 |
| 108 | A | V | L | Y | L | T | C | V | D | 1 | 5373 |
| 110 | L | Y | L | T | C | V | D | I | S | 1 | 5374 |
| 117 | I | S | L | D | C | D | L | N | C | 1 | 5375 |
| 120 | D | C | D | L | N | C | E | G | R | 1 | 5376 |
| 128 | R | Q | D | R | N | F | V | D | K | 1 | 5377 |
| 130 | D | R | N | F | V | D | K | R | Q | 1 | 5378 |
| 131 | R | N | F | V | D | K | R | Q | W | 1 | 5379 |
| 137 | R | Q | W | V | W | G | P | S | G | 1 | 5380 |
| 140 | V | W | G | P | S | G | Y | G | G | 1 | 5381 |
| 145 | G | Y | G | G | I | L | L | V | N | 1 | 5382 |
| 146 | Y | G | G | I | L | L | V | N | C | 1 | 5383 |
| 157 | D | D | P | S | C | D | V | Q | D | 1 | 5384 |
| 161 | C | D | V | Q | D | N | C | D | Q | 1 | 5385 |
| 163 | V | Q | D | N | C | D | Q | H | V | 1 | 5386 |
| 165 | D | N | C | D | Q | H | V | H | C | 1 | 5387 |
| 168 | D | Q | H | V | H | C | L | Q | D | 1 | 5388 |
| 170 | H | V | H | C | L | Q | D | L | E | 1 | 5389 |
| 172 | H | C | L | Q | D | L | E | D | M | 1 | 5390 |
| 174 | L | Q | D | L | E | D | M | S | V | 1 | 5391 |
| 195 | D | D | H | K | L | V | L | H | T | 1 | 5392 |
| 201 | L | H | S | S | Y | D | A | K | 1 | 5393 |
| 202 | H | T | S | S | Y | D | A | K | R | 1 | 5394 |
| 211 | A | Q | V | F | H | I | C | G | P | 1 | 5395 |
| 214 | F | H | I | C | G | P | E | D | V | 1 | 5396 |
| 219 | P | E | D | V | C | E | A | Y | R | 1 | 5397 |
| 226 | Y | R | H | V | L | G | Q | D | K | 1 | 5398 |
| 227 | R | H | V | L | G | Q | D | K | V | 1 | 5399 |
| 233 | D | K | V | S | Y | E | V | P | R | 1 | 5400 |
| 240 | P | R | L | H | G | D | E | E | R | 1 | 5401 |
| 250 | F | V | E | G | L | S | F | P | D | 1 | 5402 |
| 265 | I | S | F | H | V | T | L | L | D | 1 | 5403 |
| 267 | F | H | V | T | L | L | D | D | S | 1 | 5404 |
| 286 | T | D | T | V | V | F | R | V | A | 1 | 5405 |
| 291 | F | R | V | A | P | W | I | M | T | 1 | 5406 |
| 292 | R | V | A | P | W | I | M | T | P | 1 | 5407 |
| 297 | I | M | T | P | S | T | L | P | P | 1 | 5408 |
| 306 | L | E | V | Y | V | C | R | V | R | 1 | 5409 |
| 313 | V | R | N | N | T | C | F | V | D | 1 | 5410 |
| 314 | R | N | N | T | C | F | V | D | A | 1 | 5411 |
| 319 | F | V | D | A | V | A | E | L | A | 1 | 5412 |
| 334 | L | T | I | C | P | Q | A | E | N | 1 | 5413 |
| 336 | I | C | P | Q | A | E | N | R | N | 1 | 5414 |
| 343 | R | N | D | R | W | I | Q | D | E | 1 | 5415 |
| 354 | L | G | Y | V | Q | A | P | H | K | 1 | 5416 |
| 355 | G | Y | V | Q | A | P | H | K | T | 1 | 5417 |
| 357 | V | Q | A | P | H | K | T | L | P | 1 | 5418 |
| 362 | K | T | L | P | V | V | F | D | S | 1 | 5419 |
| 366 | V | V | F | D | S | P | R | N | G | 1 | 5420 |
| 367 | V | F | D | S | P | R | N | G | E | 1 | 5421 |
| 373 | N | G | E | L | Q | D | F | P | Y | 1 | 5422 |
| 374 | G | E | L | Q | D | F | P | Y | K | 1 | 5423 |
| 382 | K | R | I | L | G | P | D | F | G | 1 | 5424 |
| 387 | P | D | F | G | Y | V | T | R | E | 1 | 5425 |
| 398 | D | R | S | V | S | G | L | D | S | 1 | 5426 |
| 410 | L | E | V | S | P | V | V | V | A | 1 | 5427 |
| 416 | V | V | A | N | G | K | E | Y | P | 1 | 5428 |
| 430 | I | G | G | N | L | P | G | S | S | 1 | 5429 |
| 432 | G | N | L | P | G | S | S | G | R | 1 | 5430 |
| 446 | V | R | D | F | L | H | A | Q | K | 1 | 5431 |
| 447 | R | D | F | L | H | A | Q | K | V | 1 | 5432 |
| 448 | D | F | L | H | A | Q | K | V | Q | 1 | 5433 |
| 455 | V | Q | P | P | V | E | L | F | V | 1 | 5434 |
| 459 | V | E | L | F | V | D | W | L | A | 1 | 5435 |
| 471 | V | D | E | F | L | S | F | V | P | 1 | 5436 |
| 475 | L | S | F | V | P | A | P | D | G | 1 | 5437 |
| 477 | F | V | P | A | P | D | G | K | G | 1 | 5438 |
| 484 | K | G | F | R | M | L | L | A | S | 1 | 5439 |
| 487 | R | M | L | L | A | S | P | G | A | 1 | 5440 |
| 495 | A | C | F | K | L | F | Q | E | K | 1 | 5441 |
| 500 | F | Q | E | K | Q | K | C | G | H | 1 | 5442 |
| 507 | G | H | G | R | A | L | L | F | Q | 1 | 5443 |
| 513 | L | F | Q | G | V | V | D | D | E | 1 | 5444 |
| 515 | Q | G | V | V | D | D | E | Q | V | 1 | 5445 |
| 516 | G | V | V | D | D | E | Q | V | K | 1 | 5446 |
| 539 | N | Y | N | K | F | V | Q | S | C | 1 | 5447 |
| 541 | N | K | F | V | Q | S | C | I | D | 1 | 5448 |
| 544 | V | Q | S | C | I | D | W | N | R | 1 | 5449 |
| 549 | D | W | N | R | E | V | L | K | R | 1 | 5450 |
| 562 | A | E | C | D | I | I | D | I | P | 1 | 5451 |
| 567 | I | D | I | P | Q | L | F | K | T | 1 | 5452 |
| 582 | A | F | F | P | D | L | V | N | M | 1 | 5453 |
| 587 | L | V | N | M | L | V | L | G | K | 1 | 5454 |
| 602 | P | F | G | P | I | I | N | G | C | 1 | 5455 |
| 608 | N | G | C | C | C | L | E | E | K | 1 | 5456 |
| 609 | G | C | C | C | L | E | E | K | V | 1 | 5457 |
| 621 | L | E | P | L | G | L | H | C | T | 1 | 5458 |
| 627 | H | C | T | F | I | D | D | F | T | 1 | 5459 |
| 631 | I | D | D | F | T | P | Y | H | M | 1 | 5460 |
| 636 | P | Y | H | M | L | H | G | E | V | 1 | 5461 |
| 637 | Y | H | M | L | H | G | E | V | H | 1 | 5462 |
| 642 | G | E | V | H | C | G | T | N | V | 1 | 5463 |
| 652 | R | K | P | F | S | F | K | W | W | 1 | 5464 |
| 655 | F | S | F | K | W | W | N | M | V | 1 | 5465 |

184P1E2 v.2: HLA Peptide Scoring Results B08 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 3 | M | T | P | S | T | L | A | P | L | 10 | 5466 |
| 9 | A | P | L | E | V | Y | V | C | R | 9 | 5467 |
| 7 | T | L | A | P | L | E | V | Y | V | 7 | 5468 |
| 4 | T | P | S | T | L | A | P | L | E | 6 | 5469 |
| 8 | L | A | P | L | E | V | Y | V | C | 6 | 5470 |
| 1 | W | I | M | T | P | S | T | L | A | 4 | 5471 |
| 2 | I | M | T | P | S | T | L | A | P | 2 | 5472 |
| 5 | P | S | T | L | A | P | L | E | V | 2 | 5473 |
| 6 | S | T | L | A | P | L | E | V | Y | 2 | 5474 |

184P1E2 v.3: HLA Peptide Scoring Results B08 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | V | P | D | G | K | G | F | R | M | 17 | 5475 |
| 7 | V | P | V | P | D | G | K | G | F | 14 | 5476 |
| 3 | F | L | S | F | V | P | V | P | D | 8 | 5477 |
| 2 | E | F | L | S | F | V | P | V | P | 3 | 5478 |
| 1 | D | E | F | L | S | F | V | P | V | 2 | 5479 |
| 4 | L | S | F | V | P | V | P | D | G | 2 | 5480 |
| 5 | S | F | V | P | V | P | D | G | K | 2 | 5481 |
| 6 | F | V | P | V | P | D | G | K | G | 2 | 5482' |

TABLE XXX

| Pos | 1 | 2 | 3 | 4 | 5 | 6 | 7 | 8 | 9 | score | SEQ. ID NO. |
|---|---|---|---|---|---|---|---|---|---|---|---|

184P1E2 v.1: HLA Peptide Scoring Results B1510 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 360 | P | H | K | T | L | P | V | V | F | 21 | 5483 |
| 169 | Q | H | V | H | C | L | Q | D | L | 20 | 5484 |
| 242 | L | H | G | D | E | E | R | F | L | 19 | 5485 |
| 469 | G | H | V | D | E | F | L | S | F | 18 | 5486 |
| 595 | K | H | L | G | I | P | K | P | F | 18 | 5487 |
| 626 | L | H | C | T | F | I | D | D | F | 17 | 5488 |
| 453 | Q | K | V | Q | P | P | V | E | L | 16 | 5489 |
| 551 | N | R | E | V | L | K | R | E | L | 16 | 5490 |
| 99 | S | H | E | P | L | P | L | A | Y | 15 | 5491 |
| 234 | K | V | S | Y | E | V | P | R | L | 15 | 5492 |
| 377 | Q | D | F | P | Y | K | R | I | L | 15 | 5493 |
| 585 | P | D | L | V | N | M | L | V | L | 15 | 5494 |
| 612 | C | L | E | E | K | V | R | S | L | 15 | 5495 |
| 185 | L | R | T | Q | G | P | A | A | L | 14 | 5496 |
| 193 | L | F | D | D | H | K | L | V | L | 14 | 5497 |

TABLE XXX-continued

| Pos | 1 | 2 | 3 | 4 | 5 | 6 | 7 | 8 | 9 | score | SEQ. ID NO. |
|---|---|---|---|---|---|---|---|---|---|---|---|
| 222 | V | C | E | A | Y | R | H | V | L | 14 | 5498 |
| 263 | G | L | I | S | F | H | V | T | L | 14 | 5499 |
| 368 | F | D | S | P | R | N | G | E | L | 14 | 5500 |
| 421 | K | E | Y | P | L | G | R | I | L | 14 | 5501 |
| 481 | P | D | G | K | G | F | R | M | L | 14 | 5502 |
| 504 | Q | K | C | G | H | G | R | A | L | 14 | 5503 |
| 547 | C | I | D | W | N | R | E | V | L | 14 | 5504 |
| 3 | L | Q | R | I | V | R | V | S | L | 13 | 5505 |
| 12 | E | H | P | T | S | A | V | C | V | 13 | 5506 |
| 18 | V | C | V | A | G | V | E | T | L | 13 | 5507 |
| 96 | Y | H | S | S | H | E | P | L | P | 13 | 5508 |
| 142 | G | P | S | G | Y | G | G | I | L | 13 | 5509 |
| 177 | L | E | D | M | S | V | M | V | L | 13 | 5510 |
| 318 | C | F | V | D | A | V | A | E | L | 13 | 5511 |
| 356 | Y | V | Q | A | P | H | K | T | L | 13 | 5512 |
| 450 | L | H | A | Q | K | V | Q | P | P | 13 | 5513 |
| 613 | L | E | E | K | V | R | S | L | L | 13 | 5514 |
| 637 | Y | H | M | L | H | G | E | V | H | 13 | 5515 |
| 644 | V | H | C | G | T | N | V | C | R | 13 | 5516 |
| 72 | A | T | L | E | I | I | V | V | M | 12 | 5517 |
| 97 | H | S | S | H | E | P | L | P | L | 12 | 5518 |
| 102 | P | L | P | L | A | Y | A | V | L | 12 | 5519 |
| 104 | P | L | A | Y | A | V | L | Y | L | 12 | 5520 |
| 166 | N | C | D | Q | H | V | H | C | L | 12 | 5521 |
| 214 | F | H | I | C | G | P | E | D | V | 12 | 5522 |
| 246 | E | E | R | F | F | V | E | G | L | 12 | 5523 |
| 264 | L | I | S | F | H | V | T | L | L | 12 | 5524 |
| 295 | P | W | I | M | T | P | S | T | L | 12 | 5525 |
| 346 | R | W | I | Q | D | E | M | E | L | 12 | 5526 |
| 442 | V | T | Q | V | R | D | F | L | L | 12 | 5527 |
| 458 | P | V | E | L | F | V | D | W | L | 12 | 5528 |
| 482 | D | G | K | G | F | R | M | L | L | 12 | 5529 |
| 505 | K | C | G | H | G | R | A | L | L | 12 | 5530 |
| 524 | K | T | I | S | I | N | Q | V | L | 12 | 5531 |
| 553 | E | V | L | K | R | E | L | G | L | 12 | 5532 |
| 564 | C | D | I | I | D | I | P | Q | L | 12 | 5533 |
| 583 | F | F | P | D | L | V | N | M | L | 12 | 5534 |
| 66 | R | R | W | R | F | D | A | T | L | 11 | 5535 |
| 79 | V | M | N | S | P | S | N | D | L | 11 | 5536 |
| 90 | S | H | V | Q | I | S | Y | H | S | 11 | 5537 |
| 111 | Y | L | T | C | V | D | I | S | L | 11 | 5538 |
| 143 | P | S | G | Y | G | G | I | L | L | 11 | 5539 |
| 171 | V | H | C | L | Q | D | L | E | D | 11 | 5540 |
| 196 | D | H | K | L | V | L | H | T | S | 11 | 5541 |
| 201 | L | H | T | S | S | Y | D | A | K | 11 | 5542 |
| 206 | Y | D | A | K | R | A | Q | V | F | 11 | 5543 |
| 227 | R | H | V | L | G | Q | D | K | V | 11 | 5544 |
| 256 | F | P | D | A | G | F | T | G | L | 11 | 5545 |
| 298 | M | T | P | S | T | L | P | P | L | 11 | 5546 |
| 326 | L | A | R | K | A | G | C | K | L | 11 | 5547 |
| 396 | P | R | D | R | S | V | S | G | L | 11 | 5548 |
| 402 | S | G | L | D | S | F | G | N | L | 11 | 5549 |
| 417 | V | A | N | G | K | E | Y | P | L | 11 | 5550 |
| 426 | G | R | I | L | I | G | G | N | L | 11 | 5551 |
| 491 | A | S | P | G | A | C | F | K | L | 11 | 5552 |
| 507 | G | H | G | R | A | L | L | F | Q | 11 | 5553 |
| 579 | K | A | T | A | F | F | P | D | L | 11 | 5554 |
| 589 | N | M | L | V | L | G | K | H | L | 11 | 5555 |
| 605 | P | I | I | N | G | C | C | C | L | 11 | 5556 |
| 618 | R | S | L | L | L | E | P | L | G | 11 | 5557 |
| 632 | D | D | F | T | P | Y | H | M | L | 11 | 5558 |
| 640 | L | H | G | E | V | H | C | G | T | 11 | 5559 |
| 31 | G | S | V | P | E | G | T | E | M | 10 | 5560 |
| 95 | S | Y | H | S | S | H | E | P | L | 10 | 5561 |
| 115 | V | D | I | S | L | D | C | D | L | 10 | 5562 |
| 175 | Q | D | L | E | D | M | S | V | M | 10 | 5563 |
| 191 | A | A | L | F | D | D | H | K | L | 10 | 5564 |
| 267 | F | H | V | T | L | L | D | D | S | 10 | 5565 |
| 283 | P | I | F | T | D | T | V | V | F | 10 | 5566 |
| 441 | R | V | T | Q | V | V | R | D | F | 10 | 5567 |
| 454 | K | V | Q | P | P | V | E | L | F | 10 | 5568 |
| 467 | A | V | G | H | V | D | E | F | L | 10 | 5569 |
| 529 | N | Q | V | L | S | N | K | D | L | 10 | 5570 |
| 582 | A | F | F | P | D | L | V | N | M | 10 | 5571 |
| 616 | K | V | R | S | L | L | E | P | L | 10 | 5572 |
| 62 | R | A | D | T | R | R | W | R | F | 9 | 5573 |
| 241 | R | L | H | G | D | E | E | R | F | 9 | 5574 |
| 253 | G | L | S | F | P | D | A | G | F | 9 | 5575 |
| 411 | E | V | S | P | P | V | V | A | N | 9 | 5576 |
| 466 | L | A | V | G | H | V | D | E | F | 9 | 5577 |
| 478 | V | P | A | P | D | G | K | G | F | 9 | 5578 |
| 480 | A | P | D | G | K | G | F | R | M | 9 | 5579 |
| 575 | T | E | R | K | K | A | T | A | F | 9 | 5580 |
| 622 | E | P | L | G | L | H | C | T | F | 9 | 5581 |
| 631 | I | D | D | F | T | P | Y | H | M | 9 | 5582 |
| 647 | G | T | N | V | C | R | K | P | F | 9 | 5583 |
| 32 | S | V | P | E | G | T | E | M | F | 8 | 5584 |
| 51 | Y | I | S | P | N | M | E | R | G | 8 | 5585 |
| 125 | E | E | G | R | Q | D | R | N | F | 8 | 5586 |
| 186 | R | T | Q | G | P | A | A | L | F | 8 | 5587 |
| 277 | E | D | F | S | A | S | P | I | F | 8 | 5588 |
| 290 | V | R | F | V | A | P | W | I | M | 8 | 5589 |
| 381 | Y | K | R | I | L | G | P | D | F | 8 | 5590 |
| 489 | L | L | A | S | P | G | A | C | F | 8 | 5591 |
| 565 | D | I | I | D | I | P | Q | L | F | 8 | 5592 |
| 576 | E | R | K | K | A | T | A | F | F | 8 | 5593 |
| 48 | V | D | I | Y | I | S | P | N | M | 7 | 5594 |
| 172 | H | C | L | Q | D | L | E | D | M | 7 | 5595 |
| 248 | R | F | F | V | E | G | L | S | F | 7 | 5596 |
| 259 | A | G | F | T | G | L | I | S | F | 7 | 5597 |
| 271 | L | L | D | D | S | N | E | D | F | 7 | 5598 |
| 307 | E | V | Y | V | C | R | V | R | N | 7 | 5599 |
| 311 | C | R | V | R | N | N | T | C | F | 7 | 5600 |
| 344 | N | D | R | W | I | Q | D | E | M | 7 | 5601 |
| 371 | P | R | N | G | E | L | Q | D | F | 7 | 5602 |
| 399 | R | S | V | S | G | L | D | S | F | 7 | 5603 |
| 435 | P | G | S | S | G | R | R | V | T | 7 | 5604 |
| 436 | G | S | S | G | R | R | V | T | Q | 7 | 5605 |
| 506 | C | G | H | G | R | A | L | L | F | 7 | 5606 |
| 535 | K | D | L | I | N | Y | N | K | F | 7 | 5607 |
| 649 | N | V | C | R | K | P | F | S | F | 7 | 5608 |
| 654 | P | F | S | F | K | W | W | N | M | 7 | 5609 |
| 1 | M | S | L | Q | R | I | V | R | V | 6 | 5610 |
| 61 | E | R | A | D | T | R | R | W | R | 6 | 5611 |
| 149 | I | L | L | V | N | C | D | R | D | 6 | 5612 |
| 216 | I | C | G | P | E | D | V | C | E | 6 | 5613 |
| 284 | I | F | T | D | T | V | V | F | R | 6 | 5614 |
| 286 | T | D | T | V | V | F | R | V | A | 6 | 5615 |
| 393 | T | R | E | P | R | D | R | S | V | 6 | 5616 |
| 409 | N | L | E | V | S | P | P | V | V | 6 | 5617 |
| 410 | L | E | V | S | P | P | V | V | A | 6 | 5618 |
| 439 | G | R | R | V | T | Q | V | V | R | 6 | 5619 |
| 492 | S | P | G | A | C | F | K | L | F | 6 | 5620 |
| 611 | C | C | L | E | E | K | V | R | S | 6 | 5621 |
| 2 | S | L | Q | R | I | V | R | V | S | 5 | 5622 |
| 30 | Y | G | S | V | P | E | G | T | E | 5 | 5623 |
| 41 | E | V | Y | G | T | P | G | V | D | 5 | 5624 |
| 43 | Y | G | T | P | G | V | D | I | Y | 5 | 5625 |
| 55 | N | M | E | R | G | R | E | R | A | 5 | 5626 |
| 73 | T | L | E | I | I | V | V | M | N | 5 | 5627 |
| 179 | D | M | S | V | M | V | L | R | T | 5 | 5628 |
| 204 | S | S | Y | D | A | K | R | A | Q | 5 | 5629 |
| 244 | G | D | E | E | R | F | F | V | E | 5 | 5630 |
| 287 | D | T | V | V | F | R | V | A | P | 5 | 5631 |
| 292 | R | V | A | P | W | I | M | T | P | 5 | 5632 |
| 301 | S | T | L | P | P | L | E | V | Y | 5 | 5633 |
| 302 | T | L | P | P | L | E | V | Y | V | 5 | 5634 |
| 305 | P | L | E | V | Y | V | C | R | V | 5 | 5635 |
| 317 | T | C | F | V | D | A | V | A | E | 5 | 5636 |
| 336 | I | C | P | Q | A | E | N | R | N | 5 | 5637 |
| 351 | E | M | E | L | G | Y | V | Q | A | 5 | 5638 |
| 386 | G | P | D | F | G | Y | V | T | R | 5 | 5639 |
| 392 | V | T | R | E | P | R | D | R | S | 5 | 5640 |
| 420 | P | K | E | Y | P | L | G | R | I | 5 | 5641 |
| 440 | R | R | V | T | Q | V | V | R | D | 5 | 5642 |
| 452 | A | Q | K | V | Q | P | P | V | E | 5 | 5643 |
| 465 | W | L | A | V | G | H | V | D | E | 5 | 5644 |
| 512 | L | L | F | Q | G | V | V | D | D | 5 | 5645 |
| 525 | T | I | S | I | N | Q | V | L | S | 5 | 5646 |
| 599 | I | P | K | P | F | G | P | I | I | 5 | 5647 |
| 11 | L | E | H | P | T | S | A | V | C | 4 | 5648 |
| 14 | P | T | S | A | V | C | V | A | G | 4 | 5649 |

TABLE XXX-continued

| Pos | 1 | 2 | 3 | 4 | 5 | 6 | 7 | 8 | 9 | score | SEQ. ID NO. |
|---|---|---|---|---|---|---|---|---|---|---|---|
| 15 | T | S | A | V | C | V | A | G | V | 4 | 5650 |
| 17 | A | V | C | V | A | G | V | E | T | 4 | 5651 |
| 28 | D | I | Y | G | S | V | P | E | G | 4 | 5652 |
| 35 | E | G | T | E | M | F | E | V | Y | 4 | 5653 |
| 36 | G | T | E | M | F | E | V | Y | G | 4 | 5654 |
| 50 | I | Y | I | S | P | N | M | E | R | 4 | 5655 |
| 52 | I | S | P | N | M | E | R | G | R | 4 | 5656 |
| 54 | P | N | M | E | R | G | R | E | R | 4 | 5657 |
| 56 | M | E | R | G | R | E | R | A | D | 4 | 5658 |
| 59 | G | R | E | R | A | D | T | R | R | 4 | 5659 |
| 60 | R | E | R | A | D | T | R | R | W | 4 | 5660 |
| 77 | I | V | V | M | N | S | P | S | N | 4 | 5661 |
| 101 | E | P | L | P | L | A | Y | A | V | 4 | 5662 |
| 124 | N | C | E | G | R | Q | D | R | N | 4 | 5663 |
| 127 | G | R | Q | D | R | N | F | V | D | 4 | 5664 |
| 131 | R | N | F | V | D | K | R | Q | W | 4 | 5665 |
| 145 | G | Y | G | G | I | L | L | V | N | 4 | 5666 |
| 156 | R | D | D | P | S | C | D | V | Q | 4 | 5667 |
| 176 | D | L | E | D | M | S | V | M | V | 4 | 5668 |
| 178 | E | D | M | S | V | M | V | L | R | 4 | 5669 |
| 203 | T | S | S | Y | D | A | K | R | A | 4 | 5670 |
| 215 | H | I | C | G | P | E | D | V | C | 4 | 5671 |
| 218 | G | P | E | D | V | C | E | A | Y | 4 | 5672 |
| 229 | V | L | G | Q | D | K | V | S | Y | 4 | 5673 |
| 235 | V | S | Y | E | V | P | R | L | H | 4 | 5674 |
| 236 | S | Y | E | V | P | R | L | H | G | 4 | 5675 |
| 245 | D | E | E | R | F | F | V | E | G | 4 | 5676 |
| 279 | F | S | A | S | P | I | F | T | D | 4 | 5677 |
| 297 | I | M | T | P | S | T | L | P | P | 4 | 5678 |
| 299 | T | P | S | T | P | P | L | E | E | 4 | 5679 |
| 306 | L | E | V | Y | V | C | R | V | R | 4 | 5680 |
| 322 | A | V | A | E | L | A | R | K | A | 4 | 5681 |
| 328 | R | K | A | G | C | K | L | T | I | 4 | 5682 |
| 338 | P | Q | A | E | N | R | N | D | R | 4 | 5683 |
| 357 | V | Q | A | P | H | K | T | L | P | 4 | 5684 |
| 359 | A | P | H | K | T | L | P | V | V | 4 | 5685 |
| 361 | H | K | T | L | P | V | V | F | D | 4 | 5686 |
| 366 | V | V | F | D | S | P | R | N | G | 4 | 5687 |
| 384 | I | L | G | P | D | F | G | Y | V | 4 | 5688 |
| 387 | P | D | F | G | Y | V | T | R | E | 4 | 5689 |
| 390 | G | Y | V | T | R | E | P | R | D | 4 | 5690 |
| 391 | Y | V | T | R | E | P | R | D | R | 4 | 5691 |
| 395 | E | P | R | D | R | S | V | S | G | 4 | 5692 |
| 405 | D | S | F | G | N | L | E | V | S | 4 | 5693 |
| 428 | I | L | I | G | G | N | L | P | G | 4 | 5694 |
| 432 | G | N | L | P | G | S | S | G | R | 4 | 5695 |
| 434 | L | P | G | S | S | G | R | R | V | 4 | 5696 |
| 473 | E | F | L | S | F | V | P | A | P | 4 | 5697 |
| 490 | L | A | S | P | G | A | C | F | K | 4 | 5698 |
| 511 | A | L | L | F | Q | G | V | V | D | 4 | 5699 |
| 516 | G | V | V | D | D | E | Q | V | K | 4 | 5700 |
| 537 | L | I | N | Y | N | K | F | V | Q | 4 | 5701 |
| 538 | I | N | Y | N | K | F | V | Q | S | 4 | 5702 |
| 546 | S | C | I | D | W | N | R | E | V | 4 | 5703 |
| 548 | I | D | W | N | R | E | V | L | K | 4 | 5704 |
| 567 | I | D | I | P | Q | L | F | K | T | 4 | 5705 |
| 569 | I | P | Q | L | F | K | T | E | R | 4 | 5706 |
| 581 | T | A | F | F | P | D | L | V | N | 4 | 5707 |
| 594 | G | K | H | L | G | I | P | K | P | 4 | 5708 |
| 643 | E | V | H | C | G | T | N | V | C | 4 | 5709 |
| 645 | H | C | G | T | N | V | C | R | K | 4 | 5710 |
| 6 | I | V | R | V | S | L | E | H | P | 3 | 5711 |
| 8 | R | V | S | L | E | H | P | T | S | 3 | 5712 |
| 10 | S | L | E | H | P | T | S | A | V | 3 | 5713 |
| 13 | H | P | T | S | A | V | C | V | A | 3 | 5714 |
| 20 | V | A | G | V | E | T | L | V | D | 3 | 5715 |
| 21 | A | G | V | E | T | L | V | D | I | 3 | 5716 |
| 22 | G | V | E | T | L | V | D | I | Y | 3 | 5717 |
| 24 | E | T | L | V | D | I | Y | G | S | 3 | 5718 |
| 27 | V | D | I | Y | G | S | V | P | E | 3 | 5719 |
| 29 | I | Y | G | S | V | P | E | G | T | 3 | 5720 |
| 38 | E | M | F | E | V | Y | G | T | P | 3 | 5721 |
| 42 | V | Y | G | T | P | G | V | D | I | 3 | 5722 |
| 45 | T | P | G | V | D | I | Y | I | S | 3 | 5723 |
| 53 | S | P | N | M | E | R | G | R | E | 3 | 5724 |
| 71 | D | A | T | L | E | I | I | V | V | 3 | 5725 |
| 75 | E | I | I | V | V | M | N | S | P | 3 | 5726 |
| 76 | I | I | V | V | M | N | S | P | S | 3 | 5727 |
| 80 | M | N | S | P | S | N | D | L | N | 3 | 5728 |
| 86 | D | L | N | D | S | H | V | Q | I | 3 | 5729 |
| 94 | I | S | Y | H | S | S | H | E | P | 3 | 5730 |
| 98 | S | S | H | E | P | L | P | L | A | 3 | 5731 |
| 106 | A | Y | A | V | L | Y | L | T | C | 3 | 5732 |
| 117 | I | S | L | D | C | D | L | N | C | 3 | 5733 |
| 123 | L | N | C | E | G | R | Q | D | R | 3 | 5734 |
| 126 | E | G | R | Q | D | R | N | F | V | 3 | 5735 |
| 128 | R | Q | D | R | N | F | V | D | K | 3 | 5736 |
| 133 | F | V | D | K | R | Q | W | V | W | 3 | 5737 |
| 144 | S | G | Y | G | G | I | L | L | V | 3 | 5738 |
| 146 | Y | G | G | I | L | L | V | N | C | 3 | 5739 |
| 165 | D | N | C | D | Q | H | V | H | C | 3 | 5740 |
| 180 | M | S | V | M | V | L | R | T | Q | 3 | 5741 |
| 187 | T | Q | G | P | A | A | L | F | D | 3 | 5742 |
| 217 | C | G | P | E | D | V | C | E | A | 3 | 5743 |
| 220 | E | D | V | C | E | A | Y | R | H | 3 | 5744 |
| 221 | D | V | C | E | A | Y | R | H | V | 3 | 5745 |
| 223 | C | E | A | Y | R | H | V | L | G | 3 | 5746 |
| 228 | H | V | L | G | Q | D | K | V | S | 3 | 5747 |
| 231 | G | Q | D | K | V | S | Y | E | V | 3 | 5748 |
| 232 | Q | D | K | V | S | Y | E | V | P | 3 | 5749 |
| 237 | Y | E | V | P | R | L | H | G | D | 3 | 5750 |
| 252 | E | G | L | S | F | P | D | A | G | 3 | 5751 |
| 260 | G | F | T | G | L | I | S | F | H | 3 | 5752 |
| 262 | T | G | L | I | S | F | H | V | T | 3 | 5753 |
| 270 | T | L | D | D | S | N | E | D | D | 3 | 5754 |
| 280 | S | A | S | P | I | F | T | D | T | 3 | 5755 |
| 285 | F | T | D | T | V | V | F | R | V | 3 | 5756 |
| 300 | P | S | T | L | P | P | L | E | V | 3 | 5757 |
| 303 | L | P | P | L | E | V | Y | V | C | 3 | 5758 |
| 304 | P | P | L | E | V | Y | V | C | R | 3 | 5759 |
| 308 | V | Y | V | C | R | V | R | N | N | 3 | 5760 |
| 320 | V | D | A | V | A | E | L | A | R | 3 | 5761 |
| 323 | V | A | E | L | A | R | K | A | G | 3 | 5762 |
| 335 | T | I | C | P | Q | A | E | N | R | 3 | 5763 |
| 339 | Q | A | E | N | R | N | D | R | W | 3 | 5764 |
| 340 | A | E | N | R | N | D | R | W | I | 3 | 5765 |
| 348 | I | Q | D | E | M | E | L | G | Y | 3 | 5766 |
| 350 | D | E | M | E | L | G | Y | V | Q | 3 | 5767 |
| 352 | M | E | L | G | Y | V | Q | A | P | 3 | 5768 |
| 355 | G | Y | V | W | A | P | H | K | T | 3 | 5769 |
| 362 | K | T | L | P | V | V | F | D | S | 3 | 5770 |
| 365 | P | V | V | F | D | S | P | R | N | 3 | 5771 |
| 374 | G | E | L | Q | D | F | P | Y | K | 3 | 5772 |
| 375 | E | L | Q | D | F | P | Y | K | R | 3 | 5773 |
| 376 | L | Q | D | F | P | Y | K | R | I | 3 | 5774 |
| 385 | L | G | P | D | F | G | Y | V | T | 3 | 5775 |
| 388 | D | F | G | Y | V | T | R | E | P | 3 | 5776 |
| 394 | R | E | P | R | D | R | S | V | S | 3 | 5777 |
| 404 | L | D | S | F | G | N | L | E | V | 3 | 5778 |
| 408 | G | N | L | E | V | S | P | P | V | 3 | 5779 |
| 412 | V | S | P | P | V | V | A | N | G | 3 | 5780 |
| 416 | V | V | A | N | G | K | E | Y | P | 3 | 5781 |
| 422 | E | Y | P | L | G | R | I | L | I | 3 | 5782 |
| 423 | Y | P | L | G | R | I | L | I | G | 3 | 5783 |
| 429 | L | I | G | G | N | L | P | G | S | 3 | 5784 |
| 430 | I | G | G | N | L | P | G | S | S | 3 | 5785 |
| 433 | N | L | P | G | S | S | G | R | R | 3 | 5786 |
| 449 | F | L | H | A | Q | K | V | Q | P | 3 | 5787 |
| 456 | Q | P | P | V | E | L | F | V | D | 3 | 5788 |
| 457 | P | P | V | E | L | F | V | D | W | 3 | 5789 |
| 460 | E | L | F | V | D | W | L | A | V | 3 | 5790 |
| 461 | L | F | V | D | W | L | A | Y | G | 3 | 5791 |
| 471 | V | D | F | F | L | S | F | V | P | 3 | 5792 |
| 475 | L | S | F | V | P | A | P | D | G | 3 | 5793 |
| 476 | S | F | V | P | A | P | D | G | K | 3 | 5794 |
| 479 | P | A | P | D | G | K | G | F | R | 3 | 5795 |
| 500 | F | Q | E | K | Q | K | C | G | H | 3 | 5796 |
| 503 | K | Q | K | C | G | H | G | R | A | 3 | 5797 |
| 517 | V | V | D | D | E | Q | V | K | T | 3 | 5798 |
| 518 | V | D | D | E | Q | V | K | T | I | 3 | 5799 |
| 519 | D | D | E | Q | V | K | T | I | S | 3 | 5800 |
| 521 | E | Q | V | K | T | I | S | I | N | 3 | 5801 |

TABLE XXX-continued

| Pos | 1 | 2 | 3 | 4 | 5 | 6 | 7 | 8 | 9 | score | SEQ. ID NO. |
|---|---|---|---|---|---|---|---|---|---|---|---|
| 526 | I | S | I | N | Q | V | L | S | N | 3 | 5802 |
| 528 | I | N | Q | V | L | S | N | K | D | 3 | 5803 |
| 550 | W | N | R | E | V | L | K | R | E | 3 | 5804 |
| 556 | K | R | E | L | G | L | A | E | C | 3 | 5805 |
| 560 | G | L | A | E | C | D | I | I | D | 3 | 5806 |
| 566 | I | I | D | I | P | Q | L | F | K | 3 | 5807 |
| 571 | Q | L | F | K | T | E | R | K | K | 3 | 5808 |
| 573 | F | K | T | E | R | K | K | A | T | 3 | 5809 |
| 574 | K | T | E | R | K | K | A | T | A | 3 | 5810 |
| 596 | H | L | G | I | P | K | P | F | G | 3 | 5811 |
| 597 | L | G | I | P | K | P | F | G | P | 3 | 5812 |
| 598 | G | I | P | K | P | F | G | P | I | 3 | 5813 |
| 601 | K | P | F | G | P | I | I | N | G | 3 | 5814 |
| 602 | P | F | G | P | I | I | N | G | C | 3 | 5815 |
| 606 | I | I | N | G | C | C | C | L | E | 3 | 5816 |
| 607 | I | N | G | C | C | C | L | E | E | 3 | 5817 |
| 620 | L | L | E | P | L | G | L | H | C | 3 | 5818 |
| 638 | H | M | L | H | G | E | V | H | C | 3 | 5819 |
| 641 | H | G | E | V | H | C | G | T | N | 3 | 5820 |
| 648 | T | N | V | C | R | K | P | F | S | 3 | 5821 |
| 4 | Q | R | I | V | R | V | S | L | E | 2 | 5822 |
| 9 | V | S | L | E | H | P | T | S | A | 2 | 5823 |
| 16 | S | A | V | C | V | A | G | V | E | 2 | 5824 |
| 19 | C | V | A | G | V | E | T | L | V | 2 | 5825 |
| 25 | T | L | V | D | I | Y | G | S | V | 2 | 5826 |
| 26 | L | V | D | I | Y | G | S | V | P | 2 | 5827 |
| 33 | V | P | E | G | T | E | M | F | E | 2 | 5828 |
| 34 | P | E | G | T | E | M | F | E | V | 2 | 5829 |
| 37 | T | E | M | F | E | V | Y | G | T | 2 | 5830 |
| 39 | M | F | E | V | Y | G | T | P | G | 2 | 5831 |
| 40 | F | E | V | Y | G | T | P | G | V | 2 | 5832 |
| 44 | G | T | P | G | V | D | I | Y | I | 2 | 5833 |
| 47 | G | V | D | I | Y | I | S | P | N | 2 | 5834 |
| 57 | E | R | G | R | E | R | A | D | T | 2 | 5835 |
| 58 | R | G | R | E | R | A | D | T | R | 2 | 5836 |
| 63 | A | D | T | R | R | W | R | F | D | 2 | 5837 |
| 65 | T | R | R | W | R | F | D | A | T | 2 | 5838 |
| 68 | W | R | F | D | A | T | L | E | I | 2 | 5839 |
| 85 | N | D | L | N | D | S | H | V | Q | 2 | 5840 |
| 89 | D | S | H | V | Q | I | S | Y | H | 2 | 5841 |
| 103 | L | P | L | A | Y | A | V | L | Y | 2 | 5842 |
| 108 | A | V | L | Y | L | T | C | V | D | 2 | 5843 |
| 109 | V | L | Y | L | T | C | V | D | I | 2 | 5844 |
| 112 | L | T | C | V | D | I | S | L | D | 2 | 5845 |
| 113 | T | C | V | D | I | S | L | D | C | 2 | 5846 |
| 119 | L | D | C | D | L | N | C | E | G | 2 | 5847 |
| 121 | C | D | L | N | C | E | G | R | Q | 2 | 5848 |
| 122 | D | L | N | C | E | G | R | Q | D | 2 | 5849 |
| 130 | D | R | N | F | V | D | K | R | Q | 2 | 5850 |
| 132 | N | F | V | D | K | R | Q | W | V | 2 | 5851 |
| 134 | V | D | K | R | Q | W | V | W | G | 2 | 5852 |
| 135 | D | K | R | Q | W | V | W | G | P | 2 | 5853 |
| 137 | R | Q | W | V | W | G | P | S | G | 2 | 5854 |
| 138 | Q | W | V | W | G | P | S | G | Y | 2 | 5855 |
| 139 | W | V | W | G | P | S | G | Y | G | 2 | 5856 |
| 140 | V | W | G | P | S | G | Y | G | G | 2 | 5857 |
| 147 | G | G | I | L | L | V | N | C | D | 2 | 5858 |
| 150 | L | L | V | N | C | D | R | D | D | 2 | 5859 |
| 154 | C | D | R | D | D | P | S | C | D | 2 | 5860 |
| 155 | D | R | D | D | P | S | C | D | V | 2 | 5861 |
| 157 | D | D | P | S | C | D | V | Q | D | 2 | 5862 |
| 158 | D | P | S | C | D | V | Q | D | N | 2 | 5863 |
| 162 | D | V | Q | D | N | C | D | Q | H | 2 | 5864 |
| 164 | Q | D | N | C | D | Q | H | V | H | 2 | 5865 |
| 181 | S | V | M | V | L | R | T | Q | G | 2 | 5866 |
| 184 | V | L | R | T | Q | G | P | A | A | 2 | 5867 |
| 189 | G | P | A | A | L | F | D | D | H | 2 | 5868 |
| 194 | F | D | D | H | K | L | V | L | H | 2 | 5869 |
| 195 | D | D | H | K | L | V | L | H | T | 2 | 5870 |
| 207 | D | A | K | R | A | Q | V | F | H | 2 | 5871 |
| 209 | K | R | A | Q | V | F | H | I | C | 2 | 5872 |
| 213 | V | F | H | I | C | G | P | E | D | 2 | 5873 |
| 224 | E | A | Y | R | H | V | L | G | Q | 2 | 5874 |
| 226 | Y | R | H | V | L | G | Q | D | K | 2 | 5875 |
| 230 | L | G | Q | D | K | V | S | Y | E | 2 | 5876 |
| 233 | D | K | V | S | Y | E | V | P | R | 2 | 5877 |
| 240 | P | R | L | H | G | D | E | E | R | 2 | 5878 |
| 243 | H | G | D | E | E | R | F | F | V | 2 | 5879 |
| 249 | F | F | V | E | G | L | S | F | P | 2 | 5880 |
| 250 | F | V | E | G | L | S | F | P | D | 2 | 5881 |
| 254 | L | S | F | P | D | A | G | F | T | 2 | 5882 |
| 255 | S | F | P | D | A | G | F | T | G | 2 | 5883 |
| 257 | P | D | A | G | F | T | G | L | I | 2 | 5884 |
| 265 | I | S | F | H | V | T | L | L | D | 2 | 5885 |
| 274 | D | S | N | E | D | F | S | A | S | 2 | 5886 |
| 275 | S | N | E | D | F | S | A | S | P | 2 | 5887 |
| 278 | D | F | S | A | S | P | I | F | T | 2 | 5888 |
| 282 | S | P | I | F | T | D | T | V | V | 2 | 5889 |
| 288 | T | V | V | F | R | V | A | P | W | 2 | 5890 |
| 309 | Y | V | C | R | V | R | N | N | T | 2 | 5891 |
| 310 | V | C | R | V | R | N | N | T | C | 2 | 5892 |
| 313 | V | R | N | N | T | C | F | V | D | 2 | 5893 |
| 314 | R | N | N | T | C | F | V | D | A | 2 | 5894 |
| 315 | N | N | T | C | F | V | D | A | V | 2 | 5895 |
| 316 | N | T | C | F | V | D | A | V | A | 2 | 5896 |
| 321 | D | A | V | A | E | L | A | R | K | 2 | 5897 |
| 325 | E | L | A | R | K | A | G | C | K | 2 | 5898 |
| 331 | G | C | K | L | T | I | C | P | Q | 2 | 5899 |
| 333 | K | L | T | I | C | P | Q | A | E | 2 | 5900 |
| 334 | L | T | I | C | P | Q | A | E | N | 2 | 5901 |
| 337 | C | P | Q | A | E | N | R | N | D | 2 | 5902 |
| 341 | E | N | R | N | D | R | W | I | Q | 2 | 5903 |
| 347 | W | I | Q | D | E | M | E | L | G | 2 | 5904 |
| 354 | L | G | Y | V | Q | A | P | H | K | 2 | 5905 |
| 363 | T | L | P | V | V | F | D | S | P | 2 | 5906 |
| 367 | V | F | D | S | P | R | N | G | E | 2 | 5907 |
| 379 | F | P | Y | K | R | I | L | G | P | 2 | 5908 |
| 382 | K | R | I | L | G | P | D | F | G | 2 | 5909 |
| 383 | R | I | L | G | P | D | F | G | Y | 2 | 5910 |
| 389 | F | G | Y | V | T | R | E | P | R | 2 | 5911 |
| 398 | D | R | S | V | S | G | L | D | S | 2 | 5912 |
| 400 | S | V | S | G | L | D | S | F | G | 2 | 5913 |
| 406 | S | F | G | N | L | E | V | S | P | 2 | 5914 |
| 415 | P | V | V | A | N | G | K | E | Y | 2 | 5915 |
| 418 | A | N | G | K | E | Y | P | L | G | 2 | 5916 |
| 419 | N | G | K | E | Y | P | L | G | R | 2 | 5917 |
| 431 | G | G | N | L | P | G | S | S | G | 2 | 5918 |
| 438 | S | G | R | R | V | T | Q | V | V | 2 | 5919 |
| 443 | T | Q | V | V | R | D | F | L | H | 2 | 5920 |
| 445 | V | V | R | D | F | L | H | A | Q | 2 | 5921 |
| 448 | D | F | L | H | A | Q | K | V | Q | 2 | 5922 |
| 451 | H | A | Q | K | V | Q | P | P | V | 2 | 5923 |
| 455 | V | Q | P | P | V | E | L | F | V | 2 | 5924 |
| 462 | F | V | D | W | L | A | V | G | H | 2 | 5925 |
| 464 | D | W | L | A | V | G | H | V | D | 2 | 5926 |
| 472 | D | E | F | L | S | F | V | P | A | 2 | 5927 |
| 474 | F | L | S | F | V | P | A | P | D | 2 | 5928 |
| 483 | G | K | G | F | R | M | L | L | A | 2 | 5929 |
| 488 | M | L | L | A | S | P | G | A | C | 2 | 5930 |
| 493 | P | G | A | C | F | K | L | F | Q | 2 | 5931 |
| 495 | A | C | F | K | L | F | Q | E | K | 2 | 5932 |
| 498 | K | L | F | Q | E | K | Q | K | C | 2 | 5933 |
| 502 | E | K | Q | K | C | G | H | G | R | 2 | 5934 |
| 509 | G | R | A | L | L | F | Q | G | V | 2 | 5935 |
| 510 | R | A | L | L | F | Q | G | V | V | 2 | 5936 |
| 513 | L | F | Q | G | V | D | D | D | E | 2 | 5937 |
| 514 | F | Q | G | V | D | D | D | E | Q | 2 | 5938 |
| 530 | Q | V | L | S | N | K | D | L | I | 2 | 5939 |
| 533 | S | N | K | D | L | I | N | Y | N | 2 | 5940 |
| 539 | N | Y | N | K | F | V | Q | S | C | 2 | 5941 |
| 545 | Q | S | C | I | D | W | N | R | E | 2 | 5942 |
| 555 | L | K | R | E | L | G | L | A | E | 2 | 5943 |
| 561 | L | A | E | C | D | I | I | D | I | 2 | 5944 |
| 562 | A | E | C | D | I | I | D | I | P | 2 | 5945 |
| 568 | D | I | P | Q | L | F | K | T | E | 2 | 5946 |
| 570 | P | Q | L | F | K | T | E | R | K | 2 | 5947 |
| 580 | A | T | A | F | F | P | D | L | V | 2 | 5948 |
| 586 | D | L | V | N | M | L | V | L | G | 2 | 5949 |
| 590 | M | L | V | L | G | K | H | L | L | 2 | 5950 |
| 600 | P | K | P | F | G | P | I | I | N | 2 | 5951 |
| 604 | G | P | I | I | N | G | C | C | C | 2 | 5952 |
| 610 | C | C | C | L | E | E | K | V | R | 2 | 5953 |

TABLE XXX-continued

| Pos | 1 | 2 | 3 | 4 | 5 | 6 | 7 | 8 | 9 | score | SEQ. ID NO. |
|---|---|---|---|---|---|---|---|---|---|---|---|
| 614 | E | E | K | V | R | S | L | L | E | 2 | 5954 |
| 615 | E | K | V | R | S | L | L | E | P | 2 | 5955 |
| 617 | V | R | S | L | L | E | P | L | G | 2 | 5956 |
| 619 | S | L | L | E | P | L | G | L | H | 2 | 5957 |
| 629 | T | F | I | D | D | F | T | P | Y | 2 | 5958 |
| 630 | F | I | D | D | F | T | P | Y | H | 2 | 5959 |
| 633 | D | F | T | P | Y | H | M | L | H | 2 | 5960 |
| 639 | M | L | H | G | E | V | H | C | G | 2 | 5961 |
| 646 | C | G | T | N | V | C | R | K | P | 2 | 5962 |
| 650 | V | C | R | K | P | F | S | F | K | 2 | 5963 |
| 651 | C | R | K | P | F | S | F | K | W | 2 | 5964 |
| 656 | S | F | K | W | W | N | M | V | P | 2 | 5965 |
| 5 | R | I | V | R | V | S | L | E | H | 1 | 5966 |
| 46 | P | G | V | D | I | Y | I | S | P | 1 | 5967 |
| 49 | D | I | Y | I | S | P | N | M | E | 1 | 5968 |
| 64 | D | T | R | R | W | R | F | D | A | 1 | 5969 |
| 70 | F | D | A | T | L | E | I | I | V | 1 | 5970 |
| 74 | L | E | I | I | V | M | N | S | 1 | 5971 |
| 78 | V | V | M | N | S | P | S | N | D | 1 | 5972 |
| 81 | N | S | P | S | N | D | L | N | D | 1 | 5973 |
| 82 | S | P | S | N | D | L | N | D | S | 1 | 5974 |
| 83 | P | S | N | D | L | N | D | S | H | 1 | 5975 |
| 84 | S | N | D | L | N | D | S | H | V | 1 | 5976 |
| 87 | L | N | D | S | H | V | Q | I | S | 1 | 5977 |
| 88 | N | D | S | H | V | Q | I | S | Y | 1 | 5978 |
| 93 | Q | I | S | Y | H | S | S | H | E | 1 | 5979 |
| 100 | H | E | P | L | P | L | A | Y | A | 1 | 5980 |
| 107 | Y | A | V | L | Y | L | T | C | V | 1 | 5981 |
| 110 | L | Y | L | T | C | V | D | I | S | 1 | 5982 |
| 116 | D | I | S | L | D | C | D | L | N | 1 | 5983 |
| 120 | D | C | D | L | N | C | E | G | R | 1 | 5984 |
| 129 | Q | D | R | N | F | V | D | K | R | 1 | 5985 |
| 141 | W | G | P | S | G | Y | G | G | I | 1 | 5986 |
| 148 | G | I | L | L | V | N | C | D | R | 1 | 5987 |
| 151 | L | V | N | C | D | R | D | D | P | 1 | 5988 |
| 152 | V | N | C | D | R | D | D | P | S | 1 | 5989 |
| 153 | N | C | D | R | D | D | P | S | C | 1 | 5990 |
| 159 | P | S | C | D | V | Q | D | N | C | 1 | 5991 |
| 160 | S | C | D | V | Q | D | N | C | D | 1 | 5992 |
| 161 | C | D | V | Q | D | N | C | D | Q | 1 | 5993 |
| 168 | D | Q | H | V | H | C | L | Q | D | 1 | 5994 |
| 173 | C | L | Q | D | L | E | D | M | S | 1 | 5995 |
| 190 | P | A | L | F | D | D | H | K | 1 | 5996 |
| 192 | A | L | F | D | D | H | K | L | V | 1 | 5997 |
| 197 | H | K | L | V | L | H | T | S | S | 1 | 5998 |
| 202 | H | T | S | S | Y | D | A | K | R | 1 | 5999 |
| 205 | S | Y | D | A | K | R | A | Q | V | 1 | 6000 |
| 208 | A | K | R | A | Q | V | F | H | I | 1 | 6001 |
| 210 | R | A | Q | V | F | H | I | C | G | 1 | 6002 |
| 211 | A | Q | V | F | H | I | C | G | P | 1 | 6003 |
| 219 | P | E | D | V | C | E | A | Y | R | 1 | 6004 |
| 238 | E | V | P | R | L | H | G | D | E | 1 | 6005 |
| 239 | V | P | R | L | H | G | D | E | E | 1 | 6006 |
| 247 | E | R | F | F | V | E | G | L | S | 1 | 6007 |
| 251 | V | E | G | L | S | F | P | D | A | 1 | 6008 |
| 266 | S | F | H | V | T | L | L | D | D | 1 | 6009 |
| 272 | L | D | D | S | N | E | D | F | S | 1 | 6010 |
| 273 | D | D | S | N | E | D | F | S | A | 1 | 6011 |
| 281 | A | S | P | I | F | T | D | T | V | 1 | 6012 |
| 289 | V | V | F | R | V | A | P | W | I | 1 | 6013 |
| 291 | F | R | V | A | P | W | I | M | T | 1 | 6014 |
| 293 | V | A | P | W | I | M | T | P | S | 1 | 6015 |
| 294 | A | P | W | I | M | T | P | S | T | 1 | 6016 |
| 296 | W | I | M | T | P | S | T | L | P | 1 | 6017 |
| 312 | R | V | R | N | N | T | C | F | V | 1 | 6018 |
| 324 | A | E | L | A | R | K | A | G | C | 1 | 6019 |
| 327 | A | R | K | A | G | C | K | L | T | 1 | 6020 |
| 330 | A | G | C | K | L | T | I | C | P | 1 | 6021 |
| 332 | C | K | L | T | I | C | P | P | A | 1 | 6022 |
| 342 | N | R | N | D | R | W | I | Q | D | 1 | 6023 |
| 343 | R | N | D | R | W | I | Q | D | E | 1 | 6024 |
| 349 | Q | D | E | M | E | L | G | Y | H | 1 | 6025 |
| 353 | E | L | G | Y | V | Q | A | V | H | 1 | 6026 |
| 364 | L | P | V | V | F | D | S | P | R | 1 | 6027 |
| 369 | D | S | P | R | N | G | E | L | Q | 1 | 6028 |
| 370 | S | P | R | N | G | E | L | Q | D | 1 | 6029 |
| 372 | R | N | G | E | L | Q | D | F | P | 1 | 6030 |
| 373 | N | G | E | L | Q | D | F | P | Y | 1 | 6031 |
| 378 | D | F | P | Y | K | R | I | L | G | 1 | 6032 |
| 403 | G | L | D | S | F | G | N | L | E | 1 | 6033 |
| 407 | F | G | N | L | E | V | S | P | P | 1 | 6034 |
| 413 | S | P | P | V | V | A | N | G | K | 1 | 6035 |
| 414 | P | P | V | V | A | N | G | K | E | 1 | 6036 |
| 425 | L | G | R | I | L | I | G | G | N | 1 | 6037 |
| 427 | R | I | L | I | G | G | N | L | P | 1 | 6038 |
| 437 | S | S | G | R | R | V | T | Q | V | 1 | 6039 |
| 463 | V | D | W | L | A | V | G | H | V | 1 | 6040 |
| 468 | V | G | H | V | D | E | F | L | S | 1 | 6041 |
| 470 | H | V | D | E | F | L | S | F | V | 1 | 6042 |
| 477 | F | V | P | A | P | D | G | K | G | 1 | 6043 |
| 484 | K | G | F | R | M | L | L | A | S | 1 | 6044 |
| 485 | G | F | R | M | L | L | A | S | P | 1 | 6045 |
| 487 | R | M | L | L | A | S | P | G | A | 1 | 6046 |
| 494 | G | A | C | F | K | L | F | Q | E | 1 | 6047 |
| 499 | L | F | Q | E | K | Q | K | C | G | 1 | 6048 |
| 501 | Q | E | K | Q | K | C | G | H | G | 1 | 6049 |
| 515 | G | G | V | V | D | D | E | Q | V | 1 | 6050 |
| 520 | D | E | Q | V | K | T | I | S | I | 1 | 6051 |
| 523 | V | K | T | I | S | I | N | Q | V | 1 | 6052 |
| 527 | S | I | N | Q | V | L | S | N | K | 1 | 6053 |
| 531 | V | L | S | N | K | D | L | I | N | 1 | 6054 |
| 532 | L | N | S | K | D | L | I | N | Y | 1 | 6055 |
| 540 | Y | N | K | F | V | Q | S | C | I | 1 | 6056 |
| 541 | N | K | F | V | Q | S | C | I | D | 1 | 6057 |
| 542 | K | F | V | Q | S | C | I | D | W | 1 | 6058 |
| 543 | F | V | Q | S | C | I | D | W | N | 1 | 6059 |
| 544 | V | Q | S | C | I | D | W | N | R | 1 | 6060 |
| 549 | D | W | N | R | E | V | L | K | R | 1 | 6061 |
| 552 | R | E | V | L | K | R | E | L | G | 1 | 6062 |
| 557 | R | E | L | G | L | A | E | C | D | 1 | 6063 |
| 558 | E | L | G | L | A | E | C | D | I | 1 | 6064 |
| 563 | E | C | D | I | I | D | I | P | Q | 1 | 6065 |
| 572 | L | F | K | T | E | R | K | K | A | 1 | 6066 |
| 578 | K | K | A | T | A | F | F | P | D | 1 | 6067 |
| 587 | L | V | N | M | L | V | L | G | K | 1 | 6068 |
| 591 | L | V | L | G | K | H | L | G | I | 1 | 6069 |
| 592 | V | L | G | K | H | L | G | I | P | 1 | 6070 |
| 608 | N | G | C | C | C | L | E | E | K | 1 | 6071 |
| 609 | G | C | C | C | L | E | E | K | V | 1 | 6072 |
| 621 | L | E | P | L | G | L | H | C | T | 1 | 6073 |
| 625 | G | L | H | C | T | F | I | D | D | 1 | 6074 |
| 628 | C | T | F | I | D | D | F | T | P | 1 | 6075 |
| 634 | F | T | P | Y | H | M | L | H | G | 1 | 6076 |
| 635 | T | P | Y | H | M | L | H | G | E | 1 | 6077 |
| 636 | P | Y | H | M | L | H | G | E | V | 1 | 6078 |
| 642 | G | E | V | H | C | G | T | N | V | 1 | 6079 |
| 653 | K | P | F | S | F | K | W | W | N | 1 | 6080 |
| 655 | F | S | F | K | W | W | N | M | V | 1 | 6081 |

184P1E2 v.2: HLA Peptide
Scoring Results B1510 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 3 | M | T | P | S | T | L | A | P | L | 10 | 6082 |
| 7 | T | L | A | P | L | E | V | Y | V | 6 | 6083 |
| 2 | I | M | T | P | S | T | L | A | P | 5 | 6084 |
| 4 | T | P | S | T | L | A | P | L | E | 3 | 6085 |
| 6 | S | T | L | A | P | L | E | V | Y | 3 | 6086 |
| 8 | L | A | P | L | E | V | Y | V | C | 3 | 6087 |
| 9 | A | P | L | E | V | Y | V | C | R | 3 | 6088 |
| 5 | P | S | T | L | A | P | L | E | V | 2 | 6089 |
| 1 | W | I | M | T | P | S | T | L | A | 1 | 6090 |

184P1E2 v.3: HLA Peptide
Scoring Results B1510 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | V | P | D | G | K | G | F | R | M | 9 | 6091 |
| 7 | V | P | V | P | D | G | K | G | F | 8 | 6092 |
| 2 | E | F | L | S | F | V | P | V | P | 5 | 6093 |
| 3 | F | L | S | F | V | P | V | P | D | 4 | 6094 |
| 4 | L | S | F | V | P | V | P | D | G | 4 | 6095 |
| 5 | S | F | V | P | V | P | D | G | K | 3 | 6096 |
| 8 | P | V | P | D | G | K | G | F | R | 3 | 6097 |

TABLE XXX-continued

| Pos | 1 | 2 | 3 | 4 | 5 | 6 | 7 | 8 | 9 | score | SEQ. ID NO. |
|---|---|---|---|---|---|---|---|---|---|---|---|
| 1 | D | E | F | L | S | F | V | P | V | 2 | 6098 |
| 6 | F | V | P | V | P | D | G | K | G | 2 | 6099' |

TABLE XXXI

| Pos | 1 | 2 | 3 | 4 | 5 | 6 | 7 | 8 | 9 | score | SEQ. ID NO. |
|---|---|---|---|---|---|---|---|---|---|---|---|
| \multicolumn{12}{c}{184P1E2 v.1: HLA Peptide Scoring Results B2705 9-mers SYFPEITHI} |
| 426 | G | R | I | L | I | G | G | N | L | 29 | 6100 |
| 59 | G | R | E | R | A | D | T | R | R | 28 | 6101 |
| 66 | R | R | W | R | F | D | A | T | L | 27 | 6102 |
| 439 | G | R | R | V | T | Q | V | V | R | 27 | 6103 |
| 240 | P | R | L | H | G | D | E | E | R | 26 | 6104 |
| 185 | L | R | T | Q | G | P | A | A | L | 25 | 6105 |
| 311 | C | R | V | R | N | N | T | C | F | 24 | 6106 |
| 371 | P | R | N | G | E | L | Q | D | F | 24 | 6107 |
| 396 | P | R | D | R | S | V | S | G | L | 23 | 6108 |
| 446 | V | R | D | F | L | H | A | Q | K | 23 | 6109 |
| 551 | N | R | E | V | L | K | R | E | L | 23 | 6110 |
| 576 | E | R | K | K | A | T | A | F | F | 23 | 6111 |
| 68 | W | R | F | D | A | T | L | E | I | 21 | 6112 |
| 226 | Y | R | H | V | L | G | Q | D | K | 21 | 6113 |
| 61 | E | R | A | D | T | R | R | W | R | 20 | 6114 |
| 248 | R | F | V | E | G | L | S | F | R | 20 | 6115 |
| 346 | R | W | I | Q | D | E | M | E | L | 20 | 6116 |
| 432 | G | N | L | P | G | S | S | G | R | 20 | 6117 |
| 186 | R | T | Q | G | P | A | A | L | F | 19 | 6118 |
| 259 | A | G | F | T | G | L | I | S | F | 19 | 6119 |
| 399 | R | S | V | S | G | L | D | S | F | 19 | 6120 |
| 440 | R | R | V | T | Q | V | V | R | D | 19 | 6121 |
| 618 | R | S | L | L | E | P | L | G | L | 19 | 6122 |
| 72 | A | T | L | E | I | V | V | M | 18 | 6123 |
| 148 | G | I | L | L | V | N | C | D | R | 18 | 6124 |
| 241 | R | L | H | G | D | E | E | R | F | 18 | 6125 |
| 260 | G | F | T | G | L | I | S | F | H | 18 | 6126 |
| 374 | G | E | L | Q | D | F | P | Y | K | 18 | 6127 |
| 383 | R | I | L | G | P | D | F | G | Y | 18 | 6128 |
| 441 | R | V | T | Q | V | V | R | D | F | 18 | 6129 |
| 495 | A | C | F | K | L | F | Q | E | K | 18 | 6130 |
| 556 | K | R | E | L | G | L | A | E | C | 18 | 6131 |
| 5 | R | I | V | R | V | S | L | E | H | 17 | 6132 |
| 31 | G | S | V | P | E | G | T | E | M | 17 | 6133 |
| 50 | I | Y | I | S | P | N | M | E | R | 17 | 6134 |
| 58 | R | G | R | E | R | A | D | T | R | 17 | 6135 |
| 62 | R | A | D | T | R | R | W | R | F | 17 | 6136 |
| 234 | K | V | S | Y | E | V | P | R | L | 17 | 6137 |
| 263 | G | L | I | S | F | H | V | T | L | 17 | 6138 |
| 382 | K | R | I | L | G | P | D | F | G | 17 | 6139 |
| 386 | G | P | D | F | G | Y | V | T | R | 17 | 6140 |
| 469 | G | H | V | D | E | F | L | S | F | 17 | 6141 |
| 524 | K | T | I | S | I | N | Q | V | L | 17 | 6142 |
| 527 | S | I | N | Q | V | L | S | N | K | 17 | 6143 |
| 535 | K | D | L | I | N | Y | N | K | F | 17 | 6144 |
| 564 | C | D | I | I | D | I | P | Q | L | 17 | 6145 |
| 571 | Q | L | F | K | T | E | R | K | K | 17 | 6146 |
| 582 | A | F | F | P | D | L | V | N | M | 17 | 6147 |
| 595 | K | H | L | G | I | P | K | P | F | 17 | 6148 |
| 191 | A | A | L | F | D | D | H | K | 16 | 6149 |
| 253 | G | L | S | F | P | D | A | G | F | 16 | 6150 |
| 321 | D | A | V | A | E | L | A | R | K | 16 | 6151 |
| 421 | K | E | Y | P | L | G | R | I | L | 16 | 6152 |
| 433 | N | L | P | G | S | S | G | R | R | 16 | 6153 |
| 453 | Q | K | V | Q | P | P | V | E | L | 16 | 6154 |
| 534 | N | K | D | L | I | N | Y | N | K | 16 | 6155 |
| 569 | I | P | Q | L | F | K | T | E | R | 16 | 6156 |
| 575 | T | E | R | K | K | A | T | A | F | 16 | 6157 |
| 622 | E | P | L | G | L | H | C | T | F | 16 | 6158 |
| 18 | V | C | V | A | G | V | E | T | L | 15 | 6159 |
| 48 | V | D | I | Y | I | S | P | N | M | 15 | 6160 |
| 127 | G | R | Q | D | R | N | F | V | D | 15 | 6161 |
| 128 | R | Q | D | R | N | F | V | D | K | 15 | 6162 |
| 142 | G | P | S | G | Y | G | G | I | L | 15 | 6163 |
| 209 | K | R | A | Q | V | F | H | I | C | 15 | 6164 |
| 277 | E | D | F | S | A | S | P | I | F | 15 | 6165 |
| 283 | P | I | F | T | D | T | V | V | F | 15 | 6166 |
| 304 | P | P | L | E | V | Y | V | C | R | 15 | 6167 |
| 328 | R | K | A | G | C | K | L | T | I | 15 | 6168 |
| 377 | Q | D | F | P | Y | K | R | I | L | 15 | 6169 |
| 402 | S | G | L | D | S | F | G | N | L | 15 | 6170 |
| 454 | K | V | Q | P | P | V | E | L | F | 15 | 6171 |
| 466 | L | A | V | G | H | V | D | E | F | 15 | 6172 |
| 491 | A | S | P | G | A | C | F | K | L | 15 | 6173 |
| 505 | K | C | G | H | G | R | A | L | L | 15 | 6174 |
| 509 | G | R | A | L | L | F | Q | G | V | 15 | 6175 |
| 516 | G | V | V | D | D | E | Q | V | K | 15 | 6176 |
| 544 | V | Q | S | C | I | D | W | N | R | 15 | 6177 |
| 549 | D | W | N | R | E | V | L | K | R | 15 | 6178 |
| 553 | E | V | L | K | R | E | L | G | L | 15 | 6179 |
| 566 | I | I | D | I | P | Q | L | F | K | 15 | 6180 |
| 570 | P | Q | L | F | K | T | E | R | K | 15 | 6181 |
| 4 | Q | R | I | V | R | V | S | L | E | 14 | 6182 |
| 44 | G | T | P | G | V | D | I | Y | I | 14 | 6183 |
| 111 | Y | L | T | C | V | D | I | S | L | 14 | 6184 |
| 115 | V | D | I | S | L | D | C | D | L | 14 | 6185 |
| 130 | D | R | N | F | V | D | K | R | Q | 14 | 6186 |
| 177 | L | E | D | M | S | V | M | V | L | 14 | 6187 |
| 198 | K | L | V | L | H | T | S | S | Y | 14 | 6188 |
| 202 | H | T | S | S | Y | D | A | K | R | 14 | 6189 |
| 206 | Y | D | A | K | R | A | Q | V | F | 14 | 6190 |
| 220 | E | D | V | C | E | A | Y | R | H | 14 | 6191 |
| 247 | E | R | F | F | V | E | G | L | S | 14 | 6192 |
| 256 | F | P | D | A | G | F | T | G | L | 14 | 6193 |
| 295 | P | W | I | M | T | P | S | T | L | 14 | 6194 |
| 301 | S | T | L | P | P | L | E | V | Y | 14 | 6195 |
| 318 | C | F | V | D | A | V | A | E | L | 14 | 6196 |
| 326 | L | A | R | K | A | G | C | K | L | 14 | 6197 |
| 335 | T | I | C | P | Q | A | E | N | R | 14 | 6198 |
| 354 | L | G | Y | V | Q | A | P | H | K | 14 | 6199 |
| 417 | V | A | N | G | K | E | Y | P | L | 14 | 6200 |
| 480 | A | P | D | G | K | G | F | R | M | 14 | 6201 |
| 481 | P | D | G | K | G | F | R | M | L | 14 | 6202 |
| 486 | F | R | M | L | L | A | S | P | G | 14 | 6203 |
| 490 | L | A | S | P | G | A | C | F | K | 14 | 6204 |
| 506 | C | G | H | G | R | A | L | L | F | 14 | 6205 |
| 529 | N | Q | V | L | S | N | K | D | L | 14 | 6206 |
| 532 | L | S | N | K | D | L | I | N | Y | 14 | 6207 |
| 585 | P | D | L | V | N | M | V | L | 14 | 6208 |
| 601 | K | P | F | G | P | I | I | N | G | 14 | 6209 |
| 605 | P | I | I | N | G | C | C | C | L | 14 | 6210 |
| 612 | C | L | E | E | K | V | R | S | L | 14 | 6211 |
| 613 | L | E | E | K | V | R | S | L | L | 14 | 6212 |
| 616 | K | V | R | S | L | L | E | P | L | 14 | 6213 |
| 632 | D | D | F | T | P | Y | H | M | L | 14 | 6214 |
| 644 | V | H | C | G | T | N | V | C | R | 14 | 6215 |
| 650 | V | C | R | K | P | F | S | F | K | 14 | 6216 |
| 651 | C | R | K | P | F | S | F | K | W | 14 | 6217 |
| 3 | L | Q | R | I | V | R | V | S | L | 13 | 6218 |
| 22 | G | V | E | T | L | V | D | I | Y | 13 | 6219 |
| 32 | S | V | P | E | G | T | E | M | F | 13 | 6220 |
| 79 | V | M | N | S | P | S | N | D | L | 13 | 6221 |
| 88 | N | D | S | H | V | Q | I | S | Y | 13 | 6222 |
| 102 | P | L | P | L | A | Y | A | V | L | 13 | 6223 |
| 123 | L | N | C | E | G | R | Q | D | R | 13 | 6224 |
| 125 | C | E | G | R | Q | D | R | N | F | 13 | 6225 |
| 129 | Q | D | R | N | F | V | D | K | R | 13 | 6226 |
| 136 | K | R | Q | W | V | W | G | P | S | 13 | 6227 |
| 143 | P | S | G | Y | G | G | I | L | L | 13 | 6228 |
| 166 | N | C | D | Q | H | V | H | C | L | 13 | 6229 |
| 172 | H | C | L | Q | D | L | E | D | M | 13 | 6230 |
| 175 | Q | D | L | E | D | M | S | V | M | 13 | 6231 |
| 193 | L | F | D | D | H | K | L | V | L | 13 | 6232 |
| 229 | V | L | G | Q | D | K | V | S | Y | 13 | 6233 |
| 264 | L | I | S | F | H | V | T | L | L | 13 | 6234 |
| 284 | I | F | T | D | T | V | V | F | R | 13 | 6235 |
| 291 | F | R | V | A | P | W | I | M | T | 13 | 6236 |
| 306 | L | E | V | Y | V | C | R | V | R | 13 | 6237 |

TABLE XXXI-continued

| Pos | 1 | 2 | 3 | 4 | 5 | 6 | 7 | 8 | 9 | score | SEQ. ID NO. |
|---|---|---|---|---|---|---|---|---|---|---|---|
| 327 | A | R | K | A | G | C | K | L | T | 13 | 6238 |
| 360 | P | H | K | T | L | P | V | V | F | 13 | 6239 |
| 364 | L | P | V | V | F | D | S | P | R | 13 | 6240 |
| 368 | F | D | S | P | R | N | G | E | L | 13 | 6241 |
| 375 | E | L | Q | D | F | P | Y | K | R | 13 | 6242 |
| 393 | T | R | E | P | R | D | R | S | V | 13 | 6243 |
| 413 | S | P | P | V | V | A | N | G | K | 13 | 6244 |
| 420 | G | K | E | Y | P | L | G | R | I | 13 | 6245 |
| 467 | A | V | G | H | V | D | E | F | L | 13 | 6246 |
| 479 | P | A | P | D | G | K | G | F | R | 13 | 6247 |
| 482 | D | G | K | G | F | R | M | L | L | 13 | 6248 |
| 497 | F | K | L | F | Q | E | K | Q | K | 13 | 6249 |
| 565 | D | I | I | D | I | P | Q | L | F | 13 | 6250 |
| 579 | K | A | T | A | F | F | P | D | L | 13 | 6251 |
| 583 | F | F | P | D | L | V | N | M | L | 13 | 6252 |
| 587 | L | V | N | M | L | V | L | G | K | 13 | 6253 |
| 588 | V | N | M | L | V | L | G | K | H | 13 | 6254 |
| 589 | N | M | L | V | L | G | K | H | L | 13 | 6255 |
| 610 | C | C | C | L | E | E | K | V | R | 13 | 6256 |
| 617 | V | R | S | L | L | E | P | L | G | 13 | 6257 |
| 619 | S | L | L | E | P | L | G | L | H | 13 | 6258 |
| 626 | L | H | C | T | F | I | D | D | F | 13 | 6259 |
| 645 | H | C | G | T | N | V | C | R | K | 13 | 6260 |
| 647 | G | T | N | V | C | R | K | P | F | 13 | 6261 |
| 7 | V | R | V | S | L | E | H | P | T | 12 | 6262 |
| 43 | Y | G | T | P | G | V | D | I | Y | 12 | 6263 |
| 54 | P | N | M | E | R | G | R | E | R | 12 | 6264 |
| 57 | E | R | G | R | E | R | A | D | T | 12 | 6265 |
| 89 | D | S | H | V | Q | I | S | Y | H | 12 | 6266 |
| 92 | V | Q | I | S | Y | H | S | S | H | 12 | 6267 |
| 97 | H | S | S | H | E | P | L | P | L | 12 | 6268 |
| 103 | L | P | L | A | Y | A | V | L | Y | 12 | 6269 |
| 104 | P | L | A | Y | A | V | L | Y | L | 12 | 6270 |
| 138 | Q | W | V | W | G | P | S | G | Y | 12 | 6271 |
| 155 | D | R | D | D | P | S | C | D | V | 12 | 6272 |
| 169 | Q | H | V | H | C | L | Q | D | L | 12 | 6273 |
| 178 | E | D | M | S | V | M | V | L | R | 12 | 6274 |
| 189 | G | P | A | A | L | F | D | D | H | 12 | 6275 |
| 190 | P | A | A | L | F | D | D | H | K | 12 | 6276 |
| 218 | G | P | E | D | V | C | E | A | Y | 12 | 6277 |
| 227 | R | H | V | L | G | Q | D | K | V | 12 | 6278 |
| 233 | D | K | V | S | Y | E | V | P | R | 12 | 6279 |
| 235 | V | S | Y | E | V | P | R | L | H | 12 | 6280 |
| 271 | L | L | D | D | S | N | E | D | F | 12 | 6281 |
| 289 | V | V | F | R | V | A | P | W | I | 12 | 6282 |
| 298 | M | T | P | S | T | L | P | P | L | 12 | 6283 |
| 325 | E | L | A | R | K | A | G | C | K | 12 | 6284 |
| 338 | P | Q | A | E | N | R | N | D | R | 12 | 6285 |
| 342 | N | R | N | D | R | W | I | Q | D | 12 | 6286 |
| 344 | N | D | R | W | I | Q | D | E | M | 12 | 6287 |
| 353 | E | L | G | Y | V | Q | A | P | H | 12 | 6288 |
| 356 | Y | V | Q | A | P | H | K | T | L | 12 | 6289 |
| 381 | Y | K | R | I | L | G | P | D | F | 12 | 6290 |
| 389 | F | G | Y | V | T | R | E | P | R | 12 | 6291 |
| 398 | D | R | S | V | S | G | L | D | S | 12 | 6292 |
| 419 | N | G | K | E | Y | P | L | G | R | 12 | 6293 |
| 458 | P | V | E | L | F | V | D | W | L | 12 | 6294 |
| 476 | S | F | V | P | A | P | D | G | K | 12 | 6295 |
| 489 | L | L | A | S | P | G | A | C | F | 12 | 6296 |
| 502 | E | K | Q | K | C | G | H | G | R | 12 | 6297 |
| 504 | Q | K | C | G | H | G | R | A | L | 12 | 6298 |
| 548 | I | D | W | N | R | E | V | L | K | 12 | 6299 |
| 591 | L | V | L | G | K | H | L | G | I | 12 | 6300 |
| 593 | L | G | K | H | L | G | I | P | K | 12 | 6301 |
| 594 | G | K | H | L | G | I | P | K | P | 12 | 6302 |
| 598 | G | I | P | K | P | F | G | P | I | 12 | 6303 |
| 608 | N | G | C | C | C | L | E | E | K | 12 | 6304 |
| 629 | T | F | I | D | D | F | T | P | Y | 12 | 6305 |
| 649 | N | V | C | R | K | P | F | S | F | 12 | 6306 |
| 654 | P | F | S | F | K | W | W | N | M | 12 | 6307 |
| 21 | A | G | V | E | T | F | L | V | G | 11 | 6308 |
| 52 | I | S | P | N | M | E | R | G | R | 11 | 6309 |
| 69 | R | F | D | A | T | L | E | I | I | 11 | 6310 |
| 83 | P | S | N | D | L | N | D | S | H | 11 | 6311 |
| 95 | S | Y | H | S | S | H | E | P | L | 11 | 6312 |
| 99 | S | H | E | P | L | P | L | A | Y | 11 | 6313 |
| 120 | D | C | D | L | N | C | E | G | R | 11 | 6314 |
| 164 | Q | D | N | C | D | Q | H | V | H | 11 | 6315 |
| 194 | F | D | D | H | K | L | V | L | H | 11 | 6316 |
| 201 | L | H | T | S | S | Y | D | A | K | 11 | 6317 |
| 207 | D | A | K | R | A | Q | V | F | H | 11 | 6318 |
| 219 | P | E | D | V | C | E | A | Y | R | 11 | 6319 |
| 222 | V | C | E | A | Y | R | H | V | L | 11 | 6320 |
| 242 | L | H | G | D | E | E | R | F | F | 11 | 6321 |
| 246 | E | E | R | F | F | V | E | G | L | 11 | 6322 |
| 313 | V | R | N | N | T | C | F | V | D | 11 | 6323 |
| 320 | V | D | A | V | A | E | L | A | R | 11 | 6324 |
| 345 | D | R | W | I | Q | D | E | M | E | 11 | 6325 |
| 348 | I | Q | D | E | M | E | L | G | Y | 11 | 6326 |
| 391 | Y | V | T | R | E | P | R | D | R | 11 | 6327 |
| 442 | V | T | Q | V | V | R | D | F | L | 11 | 6328 |
| 447 | R | D | F | L | H | A | Q | K | V | 11 | 6329 |
| 462 | F | V | D | W | L | A | V | G | H | 11 | 6330 |
| 478 | V | P | A | P | D | G | K | G | F | 11 | 6331 |
| 498 | K | L | F | Q | E | K | Q | K | C | 11 | 6332 |
| 500 | F | Q | E | K | Q | K | C | G | H | 11 | 6333 |
| 547 | C | I | D | W | N | R | E | V | L | 11 | 6334 |
| 1 | M | S | L | Q | R | I | V | R | V | 10 | 6335 |
| 35 | E | G | T | E | M | F | E | V | Y | 10 | 6336 |
| 65 | T | R | R | W | R | F | D | A | T | 10 | 6337 |
| 109 | V | L | Y | L | T | C | V | D | I | 10 | 6338 |
| 144 | S | G | Y | G | G | I | L | L | V | 10 | 6339 |
| 292 | R | V | A | P | W | I | M | T | P | 10 | 6340 |
| 373 | N | G | E | L | Q | D | F | P | Y | 10 | 6341 |
| 387 | P | D | F | G | Y | V | T | R | E | 10 | 6342 |
| 415 | P | V | V | A | N | G | K | E | Y | 10 | 6343 |
| 422 | E | Y | P | L | G | R | I | L | I | 10 | 6344 |
| 443 | T | Q | V | V | R | D | F | L | H | 10 | 6345 |
| 492 | S | P | G | A | C | F | K | L | F | 10 | 6346 |
| 510 | R | A | L | L | F | Q | G | V | V | 10 | 6347 |
| 540 | Y | N | K | F | V | Q | S | C | I | 10 | 6348 |
| 557 | R | E | L | G | L | A | E | C | D | 10 | 6349 |
| 561 | L | A | E | C | D | I | I | D | I | 10 | 6350 |
| 631 | I | D | D | F | T | P | Y | H | M | 10 | 6351 |
| 633 | D | F | T | P | Y | H | M | L | H | 10 | 6352 |
| 637 | Y | H | M | L | H | G | E | V | H | 10 | 6353 |
| 86 | D | L | N | D | S | H | V | Q | I | 9 | 6354 |
| 131 | R | N | F | V | D | K | R | Q | W | 9 | 6355 |
| 145 | G | Y | G | G | I | L | L | V | N | 9 | 6356 |
| 147 | G | G | I | L | L | V | N | C | D | 9 | 6357 |
| 162 | D | V | Q | D | N | C | D | Q | H | 9 | 6358 |
| 231 | R | Q | D | K | V | S | Y | E | V | 9 | 6359 |
| 276 | N | E | D | F | S | A | S | P | I | 9 | 6360 |
| 290 | V | F | R | V | A | P | W | I | M | 9 | 6361 |
| 376 | L | Q | D | F | P | Y | K | R | I | 9 | 6362 |
| 408 | G | N | L | E | V | S | P | P | V | 9 | 6363 |
| 427 | R | I | L | I | G | G | N | L | P | 9 | 6364 |
| 428 | I | L | I | G | G | N | L | P | G | 9 | 6365 |
| 487 | R | M | L | L | A | S | P | G | A | 9 | 6366 |
| 512 | L | L | F | Q | G | V | V | D | D | 9 | 6367 |
| 518 | V | D | D | G | Q | V | K | T | I | 9 | 6368 |
| 520 | D | E | Q | V | K | T | I | S | I | 9 | 6369 |
| 530 | Q | V | L | S | N | K | D | L | I | 9 | 6370 |
| 559 | L | G | L | A | E | C | D | I | I | 9 | 6371 |
| 599 | I | P | K | P | F | G | P | I | I | 9 | 6372 |
| 623 | P | L | G | L | H | C | T | F | I | 9 | 6373 |
| 630 | F | I | D | D | F | T | P | Y | H | 9 | 6374 |
| 8 | R | V | S | L | E | H | P | T | S | 8 | 6375 |
| 28 | D | I | Y | G | S | V | P | E | G | 8 | 6376 |
| 42 | V | Y | G | T | P | G | V | D | I | 8 | 6377 |
| 141 | W | G | P | S | G | Y | G | G | I | 8 | 6378 |
| 208 | A | K | R | A | Q | V | F | H | I | 8 | 6379 |
| 257 | P | D | A | G | F | T | G | L | I | 8 | 6380 |
| 340 | A | E | N | R | N | D | R | W | I | 8 | 6381 |
| 355 | G | Y | V | Q | A | P | H | K | T | 8 | 6382 |
| 372 | R | N | G | E | L | Q | D | F | P | 8 | 6383 |
| 379 | F | P | Y | K | R | I | L | G | P | 8 | 6384 |
| 423 | Y | P | L | G | R | I | L | I | G | 8 | 6385 |
| 611 | C | C | L | E | E | K | V | R | S | 8 | 6386 |
| 642 | G | E | V | H | C | G | T | N | V | 8 | 6387 |
| 47 | G | V | D | I | Y | I | S | P | N | 7 | 6388 |
| 67 | R | W | R | F | D | A | T | L | E | 7 | 6389 |

TABLE XXXI-continued

| Pos | 1 | 2 | 3 | 4 | 5 | 6 | 7 | 8 | 9 | score | SEQ. ID NO. |
|---|---|---|---|---|---|---|---|---|---|---|---|
| 71 | D | A | T | L | E | I | I | V | V | 7 | 6390 |
| 74 | L | E | I | I | V | V | M | N | S | 7 | 6391 |
| 117 | I | S | L | D | C | D | L | N | C | 7 | 6392 |
| 156 | R | D | D | P | S | C | D | V | Q | 7 | 6393 |
| 269 | V | T | L | L | D | D | S | N | E | 7 | 6394 |
| 331 | G | C | K | L | T | I | C | P | Q | 7 | 6395 |
| 334 | L | T | I | C | P | Q | A | E | N | 7 | 6396 |
| 343 | R | N | D | R | W | I | Q | D | E | 7 | 6397 |
| 362 | K | T | L | P | V | V | F | D | S | 7 | 6398 |
| 390 | G | Y | V | T | R | E | P | R | D | 7 | 6399 |
| 405 | D | S | F | G | N | L | E | V | S | 7 | 6400 |
| 431 | G | G | N | L | P | G | S | S | G | 7 | 6401 |
| 436 | G | S | S | G | R | R | V | T | Q | 7 | 6402 |
| 484 | K | G | F | R | M | L | L | A | S | 7 | 6403 |
| 485 | G | F | R | M | L | L | A | S | P | 7 | 6404 |
| 521 | E | Q | V | K | T | I | S | I | N | 7 | 6405 |
| 642 | K | F | V | Q | S | C | I | D | W | 7 | 6406 |
| 552 | R | E | V | L | K | R | E | L | G | 7 | 6407 |
| 558 | E | L | G | L | A | E | C | D | I | 7 | 6408 |
| 567 | I | D | I | P | Q | L | F | K | T | 7 | 6409 |
| 581 | T | A | F | F | P | D | L | V | N | 7 | 6410 |
| 653 | K | P | F | S | P | K | W | W | N | 7 | 6411 |
| 9 | V | S | L | E | H | P | T | S | A | 6 | 6412 |
| 24 | E | T | L | V | D | I | Y | G | S | 6 | 6413 |
| 27 | V | D | I | Y | G | S | V | P | E | 6 | 6414 |
| 38 | E | M | F | E | V | Y | G | T | P | 6 | 6415 |
| 60 | R | E | R | A | D | T | R | R | W | 6 | 6416 |
| 90 | S | H | V | Q | I | S | Y | H | S | 6 | 6417 |
| 94 | I | S | Y | H | S | S | H | E | P | 6 | 6418 |
| 101 | E | P | L | P | L | A | Y | A | V | 6 | 6419 |
| 124 | N | C | E | G | R | Q | D | R | N | 6 | 6420 |
| 133 | F | V | D | K | R | Q | W | V | W | 6 | 6421 |
| 137 | R | Q | W | V | W | G | P | S | G | 6 | 6422 |
| 197 | H | K | L | V | L | H | T | S | S | 6 | 6423 |
| 228 | H | V | L | G | Q | D | K | V | S | 6 | 6424 |
| 249 | F | F | V | E | G | L | S | F | P | 6 | 6425 |
| 265 | I | S | F | H | V | T | L | L | D | 6 | 6426 |
| 282 | S | P | I | F | T | D | T | V | V | 6 | 6427 |
| 322 | A | V | A | E | T | L | A | R | K | A | 6 | 6428 |
| 329 | K | A | G | C | K | L | T | I | C | 6 | 6429 |
| 336 | I | C | P | Q | A | E | N | R | N | 6 | 6430 |
| 359 | A | P | H | K | T | L | P | V | V | 6 | 6431 |
| 366 | V | V | F | D | S | P | R | N | G | 6 | 6432 |
| 394 | R | E | P | R | D | R | S | V | S | 6 | 6433 |
| 397 | R | D | R | S | V | S | G | L | D | 6 | 6434 |
| 412 | V | S | P | P | V | V | A | N | G | 6 | 6435 |
| 451 | H | A | Q | K | V | Q | P | P | V | 6 | 6436 |
| 472 | D | E | F | L | S | F | V | P | A | 6 | 6437 |
| 475 | L | S | F | V | P | A | P | D | G | 6 | 6438 |
| 494 | G | A | C | F | K | L | F | Q | E | 6 | 6439 |
| 503 | K | Q | K | C | G | H | G | R | A | 6 | 6440 |
| 517 | V | V | D | D | E | Q | V | K | T | 6 | 6441 |
| 519 | D | D | E | Q | V | K | T | I | S | 6 | 6442 |
| 523 | V | K | T | I | S | I | N | Q | V | 6 | 6443 |
| 526 | I | S | I | N | Q | V | L | S | N | 6 | 6444 |
| 528 | I | N | Q | V | L | S | N | K | D | 6 | 6445 |
| 538 | I | N | Y | N | K | F | V | Q | S | 6 | 6446 |
| 560 | G | L | A | E | C | D | I | I | D | 6 | 6447 |
| 574 | K | T | E | R | K | K | A | T | A | 6 | 6448 |
| 602 | P | F | G | P | I | I | N | G | C | 6 | 6449 |
| 609 | G | C | C | C | L | E | E | K | V | 6 | 6450 |
| 655 | F | S | F | K | W | W | N | M | V | 6 | 6451 |
| 19 | C | V | A | G | V | E | T | L | V | 5 | 6452 |
| 41 | E | V | Y | G | T | P | G | V | D | 5 | 6453 |
| 75 | E | I | I | V | V | M | N | S | P | 5 | 6454 |
| 77 | I | V | V | M | N | S | P | S | N | 5 | 6455 |
| 105 | L | A | Y | A | V | L | Y | L | T | 5 | 6456 |
| 107 | Y | A | V | L | Y | L | T | C | V | 5 | 6457 |
| 108 | A | V | L | Y | L | T | C | V | D | 5 | 6458 |
| 146 | Y | G | G | I | L | L | V | N | C | 5 | 6459 |
| 149 | I | L | L | V | N | C | D | R | D | 5 | 6460 |
| 159 | P | Y | D | L | E | D | M | S | V | 5 | 6461 |
| 174 | L | Q | D | L | E | D | M | S | V | 5 | 6462 |
| 195 | D | D | H | K | L | V | L | H | T | 5 | 6463 |
| 210 | R | A | Q | V | F | H | I | C | G | 5 | 6464 |
| 211 | A | Q | V | F | H | I | C | G | P | 5 | 6465 |
| 216 | I | C | G | P | E | D | V | C | E | 5 | 6466 |
| 244 | G | D | E | E | R | F | F | V | E | 5 | 6467 |
| 254 | L | S | F | P | D | A | G | F | T | 5 | 6468 |
| 270 | T | L | L | D | D | S | N | E | D | 5 | 6469 |
| 279 | F | S | A | S | P | I | F | T | D | 5 | 6470 |
| 303 | L | P | P | L | E | V | Y | V | C | 5 | 6471 |
| 307 | E | V | Y | V | C | R | V | R | N | 5 | 6472 |
| 314 | R | N | N | T | C | F | V | D | A | 5 | 6473 |
| 317 | T | C | F | V | D | A | V | A | E | 5 | 6474 |
| 324 | A | E | L | A | R | K | A | G | C | 5 | 6475 |
| 330 | A | G | C | K | L | T | I | C | P | 5 | 6476 |
| 332 | C | K | L | T | I | C | P | Q | A | 5 | 6477 |
| 351 | E | M | E | L | G | Y | V | Q | A | 5 | 6478 |
| 352 | M | E | L | G | Y | V | Q | A | P | 5 | 6479 |
| 365 | P | V | V | F | D | S | P | R | N | 5 | 6480 |
| 400 | S | V | S | G | L | D | S | F | G | 5 | 6481 |
| 404 | L | D | S | F | G | N | L | E | V | 5 | 6482 |
| 418 | A | N | G | K | E | Y | P | L | G | 5 | 6483 |
| 448 | D | F | L | H | A | Q | K | V | Q | 5 | 6484 |
| 459 | V | E | L | F | V | D | W | L | A | 5 | 6485 |
| 496 | C | F | K | L | F | Q | E | K | Q | 5 | 6486 |
| 507 | G | H | G | R | A | L | L | F | Q | 5 | 6487 |
| 511 | A | L | L | F | Q | G | V | V | D | 5 | 6488 |
| 522 | Q | V | K | T | I | S | I | N | Q | 5 | 6489 |
| 533 | S | N | K | D | L | I | N | Y | N | 5 | 6490 |
| 550 | W | N | R | E | V | L | K | R | E | 5 | 6491 |
| 562 | A | E | C | D | I | I | D | I | P | 5 | 6492 |
| 577 | R | K | K | A | T | A | F | F | P | 5 | 6493 |
| 590 | M | L | V | L | G | K | H | L | G | 5 | 6494 |
| 604 | G | P | I | I | N | G | C | C | C | 5 | 6495 |
| 615 | E | K | V | R | S | L | L | E | P | 5 | 6496 |
| 628 | C | T | F | I | D | D | F | T | P | 5 | 6497 |
| 638 | H | M | L | H | G | E | V | H | C | 5 | 6498 |
| 652 | R | K | P | F | S | F | K | W | W | 5 | 6499 |
| 11 | L | E | H | P | T | S | A | V | C | 4 | 6500 |
| 16 | S | A | V | C | V | A | G | V | E | 4 | 6501 |
| 23 | V | E | T | L | V | D | I | Y | G | 4 | 6502 |
| 36 | G | T | E | M | F | E | V | Y | G | 4 | 6503 |
| 40 | F | E | V | Y | G | T | P | G | V | 4 | 6504 |
| 45 | T | P | G | V | D | I | Y | I | S | 4 | 6505 |
| 46 | P | G | V | D | I | Y | I | S | P | 4 | 6506 |
| 49 | D | I | Y | I | S | P | N | M | E | 4 | 6507 |
| 55 | N | M | E | R | G | R | E | R | A | 4 | 6508 |
| 76 | I | I | V | V | M | N | S | P | S | 4 | 6509 |
| 78 | V | V | M | N | S | P | S | N | D | 4 | 6510 |
| 81 | N | S | P | S | N | D | L | N | D | 4 | 6511 |
| 85 | N | D | L | N | D | S | H | V | Q | 4 | 6512 |
| 98 | S | S | H | E | P | L | P | L | A | 4 | 6513 |
| 100 | H | E | P | L | P | L | A | Y | A | 4 | 6514 |
| 106 | A | Y | A | V | L | Y | L | T | C | 4 | 6515 |
| 112 | L | T | C | V | D | I | S | L | D | 4 | 6516 |
| 113 | T | C | V | D | I | S | L | D | C | 4 | 6517 |
| 121 | C | D | L | N | C | E | G | R | Q | 4 | 6518 |
| 135 | D | K | R | Q | W | V | W | G | P | 4 | 6519 |
| 139 | W | V | W | G | P | S | G | Y | G | 4 | 6520 |
| 161 | C | D | V | Q | D | N | C | D | Q | 4 | 6521 |
| 171 | V | H | C | L | Q | D | L | E | D | 4 | 6522 |
| 179 | D | M | S | V | M | V | L | R | T | 4 | 6523 |
| 180 | M | S | V | M | V | L | R | T | Q | 4 | 6524 |
| 181 | S | V | M | V | L | R | T | Q | G | 4 | 6525 |
| 183 | M | V | L | R | T | Q | G | P | A | 4 | 6526 |
| 192 | A | L | F | D | T | D | H | K | L | V | 4 | 6527 |
| 196 | D | H | K | L | V | L | H | T | S | 4 | 6528 |
| 199 | L | V | L | H | T | S | S | Y | D | 4 | 6529 |
| 212 | Q | V | F | H | I | C | G | P | E | 4 | 6530 |
| 214 | F | H | I | C | G | P | E | D | V | 4 | 6531 |
| 215 | H | I | C | G | P | E | D | V | C | 4 | 6532 |
| 224 | E | A | Y | R | H | V | L | G | Q | 4 | 6533 |
| 225 | A | Y | R | H | V | L | G | Q | D | 4 | 6534 |
| 250 | F | V | E | G | L | S | F | P | D | 4 | 6535 |
| 262 | T | G | L | I | S | F | H | V | T | 4 | 6536 |
| 268 | H | V | T | L | L | D | D | S | N | 4 | 6537 |
| 280 | S | A | S | P | I | F | T | D | T | 4 | 6538 |
| 285 | F | T | D | T | V | V | F | R | V | 4 | 6539 |
| 296 | W | I | M | T | P | S | T | L | P | 4 | 6540 |
| 297 | I | M | T | P | S | T | L | P | P | 4 | 6541 |

TABLE XXXI-continued

| Pos | 1 | 2 | 3 | 4 | 5 | 6 | 7 | 8 | 9 | score | SEQ. ID NO. |
|---|---|---|---|---|---|---|---|---|---|---|---|
| 300 | P | S | T | L | P | P | L | E | V | 4 | 6542 |
| 308 | V | Y | V | C | R | V | R | N | N | 4 | 6543 |
| 309 | Y | V | C | R | V | R | N | N | T | 4 | 6544 |
| 312 | R | V | R | N | N | T | C | F | V | 4 | 6545 |
| 316 | N | T | C | F | V | D | A | V | A | 4 | 6546 |
| 337 | C | P | Q | A | E | N | R | N | D | 4 | 6547 |
| 350 | D | E | M | E | L | G | Y | V | Q | 4 | 6548 |
| 357 | V | Q | A | P | H | K | T | L | P | 4 | 6549 |
| 361 | H | K | T | L | P | V | V | F | D | 4 | 6550 |
| 370 | S | P | R | N | G | E | L | Q | D | 4 | 6551 |
| 392 | V | T | R | E | P | R | D | R | S | 4 | 6552 |
| 403 | G | L | D | S | F | G | N | L | E | 4 | 6553 |
| 407 | F | G | N | L | E | V | S | P | P | 4 | 6554 |
| 410 | L | E | V | S | P | P | V | V | A | 4 | 6555 |
| 411 | E | V | S | P | P | V | V | A | N | 4 | 6556 |
| 414 | P | P | V | V | A | N | G | K | E | 4 | 6557 |
| 425 | L | G | R | I | L | I | G | G | N | 4 | 6558 |
| 429 | L | I | G | G | N | L | P | G | S | 4 | 6559 |
| 437 | S | S | G | R | R | V | T | Q | V | 4 | 6560 |
| 450 | L | H | A | Q | K | V | Q | P | P | 4 | 6561 |
| 457 | P | P | V | E | L | F | V | D | W | 4 | 6562 |
| 460 | E | L | F | V | D | W | L | A | V | 4 | 6563 |
| 461 | L | F | V | D | W | L | A | V | G | 4 | 6564 |
| 464 | D | W | L | A | V | G | H | V | D | 4 | 6565 |
| 473 | E | F | L | S | F | V | P | A | P | 4 | 6566 |
| 477 | F | V | P | A | P | D | G | K | G | 4 | 6567 |
| 483 | G | K | G | F | R | M | L | L | A | 4 | 6568 |
| 499 | L | F | Q | E | K | Q | K | C | G | 4 | 6569 |
| 513 | L | F | Q | G | V | V | D | D | E | 4 | 6570 |
| 539 | N | Y | N | K | F | V | Q | S | C | 4 | 6571 |
| 541 | N | K | F | V | Q | S | C | I | D | 4 | 6572 |
| 546 | S | C | I | D | W | N | R | E | V | 4 | 6573 |
| 568 | D | I | P | Q | L | F | K | T | E | 4 | 6574 |
| 584 | F | P | D | L | V | N | M | L | V | 4 | 6575 |
| 597 | L | G | I | P | K | P | F | G | P | 4 | 6576 |
| 621 | L | E | P | L | G | L | H | C | T | 4 | 6577 |
| 625 | G | L | H | C | T | F | I | D | D | 4 | 6578 |
| 639 | M | L | H | G | E | V | H | C | G | 4 | 6579 |
| 643 | E | V | H | C | G | T | N | V | C | 4 | 6580 |
| 2 | S | L | Q | R | I | V | R | V | S | 3 | 6581 |
| 6 | I | V | R | V | S | L | E | H | P | 3 | 6582 |
| 12 | E | H | P | T | S | A | V | C | V | 3 | 6583 |
| 17 | A | V | C | V | A | G | V | E | T | 3 | 6584 |
| 20 | V | A | G | V | E | T | L | V | D | 3 | 6585 |
| 25 | T | L | V | D | I | Y | G | S | V | 3 | 6586 |
| 33 | V | P | E | G | T | E | M | F | E | 3 | 6587 |
| 37 | T | E | M | F | E | V | Y | G | T | 3 | 6588 |
| 51 | Y | I | S | P | N | M | E | R | G | 3 | 6589 |
| 53 | S | P | N | M | E | R | G | R | E | 3 | 6590 |
| 73 | T | L | E | I | I | V | V | M | N | 3 | 6591 |
| 80 | M | N | S | P | S | N | D | L | N | 3 | 6592 |
| 84 | S | N | D | L | N | D | S | H | V | 3 | 6593 |
| 110 | L | Y | L | T | C | V | D | I | S | 3 | 6594 |
| 119 | L | D | C | D | L | N | C | E | G | 3 | 6595 |
| 126 | E | G | R | Q | D | R | N | F | V | 3 | 6596 |
| 140 | V | W | G | P | S | G | Y | G | G | 3 | 6597 |
| 153 | N | C | D | R | D | D | P | S | C | 3 | 6598 |
| 157 | D | D | P | S | C | D | V | Q | D | 3 | 6599 |
| 170 | H | V | H | C | L | Q | D | L | E | 3 | 6600 |
| 187 | T | Q | G | P | A | L | F | D | 3 | 6601 |
| 200 | V | L | H | T | S | S | Y | D | A | 3 | 6602 |
| 203 | T | S | S | Y | D | A | K | R | A | 3 | 6603 |
| 204 | S | S | Y | D | A | K | R | A | Q | 3 | 6604 |
| 205 | S | Y | D | A | K | R | A | Q | V | 3 | 6605 |
| 217 | C | G | P | E | D | V | C | E | A | 3 | 6606 |
| 230 | L | G | Q | D | K | V | S | Y | E | 3 | 6607 |
| 237 | Y | E | V | P | R | L | H | G | D | 3 | 6608 |
| 251 | V | E | G | L | S | F | P | D | A | 3 | 6609 |
| 261 | F | T | G | L | I | S | F | H | V | 3 | 6610 |
| 267 | F | H | V | T | L | D | D | S | 3 | 6611 |
| 273 | D | D | S | N | E | D | F | S | A | 3 | 6612 |
| 275 | S | N | E | D | F | S | A | S | P | 3 | 6613 |
| 288 | T | V | V | F | R | V | A | P | W | 3 | 6614 |
| 293 | V | A | P | W | I | M | T | P | S | 3 | 6615 |
| 294 | A | P | W | I | M | T | P | S | T | 3 | 6616 |
| 302 | T | L | P | P | L | E | V | Y | V | 3 | 6617 |

| Pos | 1 | 2 | 3 | 4 | 5 | 6 | 7 | 8 | 9 | score | SEQ. ID NO. |
|---|---|---|---|---|---|---|---|---|---|---|---|
| 305 | P | L | E | V | Y | V | C | R | V | 3 | 6618 |
| 310 | V | C | R | V | R | N | N | T | C | 3 | 6619 |
| 339 | Q | A | E | N | R | N | D | R | W | 3 | 6620 |
| 395 | E | P | R | D | R | S | V | S | G | 3 | 6621 |
| 406 | S | F | G | N | L | E | V | S | P | 3 | 6622 |
| 409 | N | L | E | V | S | P | P | V | V | 3 | 6623 |
| 416 | V | V | A | N | G | K | E | Y | P | 3 | 6624 |
| 424 | P | L | G | R | I | L | I | G | G | 3 | 6625 |
| 430 | I | G | G | N | L | P | G | S | S | 3 | 6626 |
| 434 | L | P | G | S | S | G | R | R | V | 3 | 6627 |
| 435 | P | G | S | S | G | R | R | V | T | 3 | 6628 |
| 449 | F | L | H | A | Q | K | V | Q | P | 3 | 6629 |
| 452 | A | Q | K | V | Q | P | P | V | E | 3 | 6630 |
| 455 | V | Q | P | P | V | E | L | F | V | 3 | 6631 |
| 456 | Q | P | P | V | E | L | F | V | D | 3 | 6632 |
| 465 | W | L | A | V | G | H | V | D | E | 3 | 6633 |
| 470 | H | V | D | E | F | L | S | F | V | 3 | 6634 |
| 471 | V | D | E | F | L | S | F | V | P | 3 | 6635 |
| 488 | M | L | L | A | S | P | G | A | C | 3 | 6636 |
| 501 | Q | E | K | Q | K | C | G | H | G | 3 | 6637 |
| 508 | H | G | R | A | L | L | F | Q | G | 3 | 6638 |
| 514 | F | Q | G | V | V | D | D | E | Q | 3 | 6639 |
| 515 | Q | G | V | V | D | D | E | Q | V | 3 | 6640 |
| 525 | T | I | S | I | N | Q | V | L | S | 3 | 6641 |
| 531 | V | L | S | N | K | D | L | I | N | 3 | 6642 |
| 536 | D | L | I | N | Y | N | K | F | V | 3 | 6643 |
| 543 | F | V | Q | S | C | I | D | W | N | 3 | 6644 |
| 545 | Q | S | C | I | D | W | N | R | E | 3 | 6645 |
| 555 | L | K | R | E | L | G | L | A | E | 3 | 6646 |
| 563 | E | C | D | I | I | D | I | P | Q | 3 | 6647 |
| 572 | L | F | K | T | E | R | K | K | A | 3 | 6648 |
| 586 | D | L | V | N | M | L | V | L | G | 3 | 6649 |
| 592 | V | L | G | K | H | L | G | I | P | 3 | 6650 |
| 596 | H | L | G | I | P | K | P | F | G | 3 | 6651 |
| 600 | P | K | P | F | G | P | I | N | 3 | 6652 |
| 606 | I | I | N | G | C | C | C | L | E | 3 | 6653 |
| 607 | I | N | G | C | C | C | L | E | E | 3 | 6654 |
| 620 | L | L | E | P | L | G | L | H | C | 3 | 6655 |
| 635 | T | P | Y | H | M | L | H | G | E | 3 | 6656 |
| 646 | C | G | T | N | V | C | R | K | P | 3 | 6657 |
| 648 | T | N | V | C | R | K | P | F | S | 3 | 6658 |
| 656 | S | F | K | W | W | N | M | V | P | 3 | 6659 |
| 10 | S | L | E | H | P | T | S | A | V | 2 | 6660 |
| 13 | H | P | T | S | A | V | C | V | A | 2 | 6661 |
| 14 | P | T | S | A | V | C | V | A | G | 2 | 6662 |
| 15 | T | S | A | V | C | V | A | G | V | 2 | 6663 |
| 26 | L | V | D | I | Y | G | S | V | P | 2 | 6664 |
| 29 | I | Y | G | S | V | P | E | G | T | 2 | 6665 |
| 30 | Y | G | S | V | P | E | G | T | E | 2 | 6666 |
| 34 | P | E | G | T | E | M | F | E | V | 2 | 6667 |
| 39 | M | F | E | V | Y | G | T | P | G | 2 | 6668 |
| 56 | M | E | R | G | R | E | R | A | D | 2 | 6669 |
| 70 | F | D | A | T | L | E | I | I | V | 2 | 6670 |
| 82 | S | P | S | N | D | L | N | D | S | 2 | 6671 |
| 91 | H | V | Q | I | S | Y | H | S | S | 2 | 6672 |
| 93 | Q | I | S | Y | H | S | S | H | E | 2 | 6673 |
| 114 | C | V | D | I | S | L | D | C | D | 2 | 6674 |
| 118 | S | L | D | C | D | L | N | C | E | 2 | 6675 |
| 122 | D | L | N | C | E | G | R | Q | D | 2 | 6676 |
| 132 | N | F | V | D | K | R | Q | W | V | 2 | 6677 |
| 150 | L | L | V | N | C | D | R | D | D | 2 | 6678 |
| 160 | S | C | D | V | Q | D | N | C | D | 2 | 6679 |
| 168 | D | Q | H | V | H | C | L | Q | D | 2 | 6680 |
| 176 | D | L | E | D | M | S | V | M | V | 2 | 6681 |
| 182 | V | M | V | L | R | T | Q | G | P | 2 | 6682 |
| 213 | V | F | H | I | C | G | P | E | D | 2 | 6683 |
| 232 | Q | D | K | V | S | Y | E | V | P | 2 | 6684 |
| 236 | S | Y | E | V | P | R | L | H | G | 2 | 6685 |
| 239 | V | P | R | L | H | G | D | E | E | 2 | 6686 |
| 243 | H | G | D | E | E | R | F | F | V | 2 | 6687 |
| 245 | D | E | E | R | F | F | V | E | G | 2 | 6688 |
| 252 | E | G | L | S | F | P | D | A | G | 2 | 6689 |
| 266 | S | F | H | V | T | L | L | D | D | 2 | 6690 |
| 274 | D | S | N | E | D | F | S | A | S | 2 | 6691 |
| 278 | D | F | S | A | S | P | I | F | T | 2 | 6692 |
| 281 | A | S | P | I | F | T | D | T | V | 2 | 6693 |

TABLE XXXI-continued

| Pos | 1 | 2 | 3 | 4 | 5 | 6 | 7 | 8 | 9 | score | SEQ. ID NO. |
|---|---|---|---|---|---|---|---|---|---|---|---|
| 286 | T | D | T | V | V | F | R | V | A | 2 | 6694 |
| 287 | D | T | V | V | F | R | V | A | P | 2 | 6695 |
| 299 | T | P | S | T | L | P | P | L | E | 2 | 6696 |
| 319 | F | V | D | A | V | A | E | L | A | 2 | 6697 |
| 333 | K | L | T | I | C | P | Q | A | E | 2 | 6698 |
| 349 | Q | D | E | M | E | L | G | Y | V | 2 | 6699 |
| 358 | Q | A | P | H | K | T | L | P | V | 2 | 6700 |
| 363 | T | L | P | V | V | F | D | S | P | 2 | 6701 |
| 367 | V | F | D | S | P | R | N | G | E | 2 | 6702 |
| 378 | D | F | P | Y | K | R | I | L | G | 2 | 6703 |
| 380 | P | Y | K | R | I | L | G | P | D | 2 | 6704 |
| 384 | I | L | G | P | D | F | G | Y | V | 2 | 6705 |
| 385 | L | G | P | D | F | G | Y | V | T | 2 | 6706 |
| 388 | D | F | G | Y | V | T | R | E | P | 2 | 6707 |
| 401 | V | S | G | L | D | S | F | G | N | 2 | 6708 |
| 438 | S | G | R | R | V | T | Q | V | V | 2 | 6709 |
| 444 | Q | V | V | R | D | F | L | H | A | 2 | 6710 |
| 463 | V | D | W | L | A | V | G | H | V | 2 | 6711 |
| 474 | F | L | S | F | V | P | A | P | D | 2 | 6712 |
| 493 | P | G | A | C | F | K | L | F | Q | 2 | 6713 |
| 537 | L | I | N | Y | N | K | F | V | Q | 2 | 6714 |
| 554 | V | L | K | R | E | L | G | L | A | 2 | 6715 |
| 573 | F | K | T | E | R | K | K | A | T | 2 | 6716 |
| 578 | K | K | A | T | A | F | F | P | D | 2 | 6717 |
| 603 | F | G | P | I | I | N | G | C | C | 2 | 6718 |
| 614 | E | E | K | V | R | S | L | L | E | 2 | 6719 |
| 624 | L | G | L | H | C | T | F | I | D | 2 | 6720 |
| 627 | H | C | T | F | I | D | D | F | T | 2 | 6721 |
| 636 | P | Y | H | M | L | H | G | E | V | 2 | 6722 |
| 640 | L | H | G | E | V | H | C | G | T | 2 | 6723 |
| 63 | A | D | T | R | R | W | R | F | D | 1 | 6724 |
| 87 | L | N | D | S | H | V | Q | I | S | 1 | 6725 |
| 96 | Y | H | S | S | H | E | P | L | P | 1 | 6726 |
| 116 | D | I | S | L | D | C | D | L | N | 1 | 6727 |
| 134 | V | K | D | R | Q | W | V | W | G | 1 | 6728 |
| 152 | V | N | C | D | R | D | D | P | S | 1 | 6729 |
| 154 | C | D | R | D | D | P | S | C | D | 1 | 6730 |
| 158 | D | P | S | C | D | V | Q | D | N | 1 | 6731 |
| 163 | V | Q | D | N | C | D | Q | H | V | 1 | 6732 |
| 165 | D | N | C | D | Q | H | V | H | C | 1 | 6733 |
| 167 | C | D | Q | H | V | H | C | L | Q | 1 | 6734 |
| 173 | C | L | Q | D | L | E | D | M | S | 1 | 6735 |
| 184 | V | L | R | T | Q | G | P | A | A | 1 | 6736 |
| 188 | Q | G | P | A | A | L | F | D | D | 1 | 6737 |
| 221 | D | V | C | E | A | Y | R | H | V | 1 | 6738 |
| 223 | C | E | A | Y | R | H | V | L | G | 1 | 6739 |
| 238 | E | V | P | R | L | H | G | D | E | 1 | 6740 |
| 255 | S | F | P | D | A | G | F | T | G | 1 | 6741 |
| 258 | D | A | G | F | T | G | L | I | S | 1 | 6742 |
| 315 | N | N | T | C | F | V | D | A | V | 1 | 6743 |
| 323 | V | A | E | L | A | R | K | A | G | 1 | 6744 |
| 341 | E | N | R | N | D | R | W | I | Q | 1 | 6745 |
| 347 | W | I | Q | D | E | M | E | L | G | 1 | 6746 |
| 445 | V | V | R | D | F | L | H | A | Q | 1 | 6747 |
| 580 | A | T | A | F | F | P | D | L | V | 1 | 6748 |
| 634 | F | T | P | Y | H | M | L | H | G | 1 | 6749 |
| 641 | H | G | E | V | H | C | G | T | N | 1 | 6750 |

184P1E2 v.2: HLA Peptide Scoring Results B2705 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 9 | A | P | L | E | V | Y | V | C | R | 16 | 6751 |
| 6 | S | T | L | A | P | L | E | V | Y | 13 | 6752 |
| 3 | M | T | P | S | T | L | A | P | L | 12 | 6753 |
| 8 | L | A | P | L | E | V | Y | V | C | 5 | 6754 |
| 1 | W | I | M | T | P | S | T | L | A | 4 | 6755 |
| 2 | I | M | T | P | S | T | L | A | P | 4 | 6756 |
| 4 | T | P | S | T | L | A | P | L | E | 3 | 6757 |
| 5 | P | S | T | L | A | P | L | E | V | 3 | 6758 |
| 7 | T | L | A | P | L | E | V | Y | V | 3 | 6759 |

184P1E2 v.3: HLA Peptide Scoring Results B2705 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 5 | S | F | V | P | V | P | D | G | K | 13 | 6760 |
| 8 | P | V | P | D | G | K | G | F | R | 13 | 6761 |
| 9 | V | P | D | G | K | G | F | R | M | 13 | 6762 |
| 7 | V | P | V | P | D | G | K | G | F | 12 | 6763 |
| 1 | D | E | F | L | S | F | V | P | V | 6 | 6764 |
| 4 | L | S | F | V | P | V | P | D | G | 6 | 6765 |
| 2 | E | F | L | S | F | V | P | V | P | 5 | 6766 |
| 6 | F | V | P | V | P | D | G | K | G | 4 | 6767 |
| 3 | F | L | S | F | V | P | V | P | D | 2 | 6768' |

TABLE XXXII

184P1E2 v.1: HLA Peptide Scoring Results B2709 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 426 | G | R | I | L | I | G | G | N | L | 26 | 6769 |
| 66 | R | R | W | R | F | D | A | T | L | 24 | 6770 |
| 68 | W | R | F | D | A | T | L | E | I | 21 | 6771 |
| 185 | L | R | T | Q | G | P | A | A | L | 21 | 6772 |
| 396 | P | R | D | R | S | V | S | G | L | 21 | 6773 |
| 509 | G | R | A | L | L | F | Q | G | V | 21 | 6774 |
| 551 | N | R | E | V | L | K | R | E | L | 20 | 6775 |
| 311 | C | R | V | R | N | N | T | C | F | 19 | 6776 |
| 393 | T | R | E | P | R | D | R | S | V | 19 | 6777 |
| 155 | D | R | D | D | P | S | C | D | V | 18 | 6778 |
| 371 | P | R | N | G | E | L | Q | D | F | 18 | 6779 |
| 440 | R | R | V | T | Q | V | V | R | D | 18 | 6780 |
| 576 | E | R | K | K | A | T | A | F | F | 18 | 6781 |
| 618 | R | S | L | L | E | P | L | G | L | 17 | 6782 |
| 263 | G | L | I | S | F | H | V | T | L | 16 | 6783 |
| 346 | R | W | I | Q | D | E | M | E | L | 16 | 6784 |
| 234 | K | V | S | Y | E | V | P | R | L | 15 | 6785 |
| 248 | R | F | F | V | E | G | L | S | F | 15 | 6786 |
| 421 | K | E | Y | P | L | G | R | I | L | 15 | 6787 |
| 447 | R | D | F | L | H | A | Q | K | V | 15 | 6788 |
| 524 | K | T | I | S | I | N | Q | V | L | 15 | 6789 |
| 582 | A | F | F | P | D | L | V | N | M | 15 | 6790 |
| 59 | G | R | E | R | A | D | T | R | R | 14 | 6791 |
| 191 | A | A | L | F | D | D | H | K | L | 14 | 6792 |
| 241 | R | L | H | G | D | E | E | R | F | 14 | 6793 |
| 399 | R | S | V | S | G | L | D | S | F | 14 | 6794 |
| 408 | G | N | L | E | V | S | P | P | V | 14 | 6795 |
| 439 | G | R | R | V | T | Q | V | V | R | 14 | 6796 |
| 441 | R | V | T | Q | V | V | R | D | F | 14 | 6797 |
| 510 | R | A | L | L | F | Q | G | V | V | 14 | 6798 |
| 564 | C | D | I | I | D | I | P | Q | L | 14 | 6799 |
| 579 | K | A | T | A | F | F | P | D | L | 14 | 6800 |
| 31 | G | S | V | P | E | G | T | E | M | 13 | 6801 |
| 62 | R | A | D | T | R | R | W | R | F | 13 | 6802 |
| 72 | A | T | L | E | I | I | V | R | F | 13 | 6803 |
| 101 | E | P | L | P | L | A | Y | A | V | 13 | 6804 |
| 127 | G | R | Q | D | R | N | F | V | D | 13 | 6805 |
| 142 | G | P | S | G | Y | G | G | I | L | 13 | 6806 |
| 186 | R | T | Q | G | P | A | A | L | F | 13 | 6807 |
| 227 | R | H | V | L | G | Q | D | K | V | 13 | 6808 |
| 328 | R | K | A | G | C | K | L | T | I | 13 | 6809 |
| 377 | Q | D | F | P | Y | K | R | I | L | 13 | 6810 |
| 382 | K | R | I | L | G | P | D | F | G | 13 | 6811 |
| 402 | S | G | L | D | S | F | G | N | L | 13 | 6812 |
| 469 | G | H | V | D | E | F | L | S | F | 13 | 6813 |
| 553 | E | V | L | K | R | E | L | G | L | 13 | 6814 |
| 585 | P | D | L | V | N | M | L | V | L | 13 | 6815 |
| 595 | K | H | L | G | I | P | K | P | F | 13 | 6816 |
| 616 | K | V | R | S | L | L | E | P | L | 13 | 6817 |
| 642 | G | E | V | H | C | G | T | N | V | 13 | 6818 |
| 1 | M | S | L | Q | R | I | V | R | V | 12 | 6819 |
| 4 | Q | R | I | V | R | V | S | L | E | 12 | 6820 |
| 7 | V | R | V | S | L | E | H | P | T | 12 | 6821 |
| 18 | V | C | V | A | G | V | E | T | L | 12 | 6822 |
| 48 | V | D | I | Y | I | S | P | N | M | 12 | 6823 |
| 69 | R | F | D | A | T | L | E | I | I | 12 | 6824 |
| 104 | P | L | A | Y | A | V | L | Y | L | 12 | 6825 |
| 115 | V | D | I | S | L | D | C | D | L | 12 | 6826 |
| 136 | K | R | Q | W | V | W | G | P | S | 12 | 6827 |

TABLE XXXII-continued

| Pos | 1 | 2 | 3 | 4 | 5 | 6 | 7 | 8 | 9 | score | SEQ. ID NO. |
|---|---|---|---|---|---|---|---|---|---|---|---|
| 192 | A | L | F | D | D | H | K | L | V | 12 | 6828 |
| 209 | K | R | A | Q | V | F | H | I | C | 12 | 6829 |
| 231 | G | Q | D | K | V | S | Y | E | V | 12 | 6830 |
| 240 | P | R | L | H | G | D | E | E | R | 12 | 6831 |
| 247 | E | R | F | F | V | E | G | L | S | 12 | 6832 |
| 277 | E | D | F | S | A | S | P | I | F | 12 | 6833 |
| 283 | P | I | F | T | D | T | V | V | F | 12 | 6834 |
| 289 | V | V | F | R | V | A | P | W | I | 12 | 6835 |
| 298 | M | T | P | S | T | L | P | P | L | 12 | 6836 |
| 312 | R | V | R | N | N | T | C | F | V | 12 | 6837 |
| 318 | C | F | V | D | A | V | A | E | L | 12 | 6838 |
| 420 | G | K | E | Y | P | L | G | R | I | 12 | 6839 |
| 453 | Q | K | V | Q | P | P | V | E | L | 12 | 6840 |
| 454 | K | V | Q | P | P | V | E | L | F | 12 | 6841 |
| 460 | E | L | F | V | D | W | L | A | V | 12 | 6842 |
| 505 | K | C | G | H | G | R | A | L | L | 12 | 6843 |
| 535 | K | D | L | I | N | Y | N | K | F | 12 | 6844 |
| 556 | K | R | E | L | G | L | A | E | C | 12 | 6845 |
| 589 | N | M | L | V | L | G | K | H | L | 12 | 6846 |
| 632 | D | D | F | T | P | Y | H | M | L | 12 | 6847 |
| 3 | L | Q | R | I | V | R | V | S | L | 11 | 6848 |
| 21 | A | G | V | E | T | L | V | D | I | 11 | 6849 |
| 44 | G | T | P | G | V | D | I | Y | I | 11 | 6850 |
| 79 | V | M | N | S | P | S | N | D | L | 11 | 6851 |
| 95 | S | Y | H | S | S | H | E | P | L | 11 | 6852 |
| 97 | H | S | S | H | E | P | L | P | L | 11 | 6853 |
| 109 | V | L | Y | L | T | C | V | D | I | 11 | 6854 |
| 111 | Y | L | T | C | V | D | I | S | L | 11 | 6855 |
| 130 | D | R | N | F | V | D | K | R | Q | 11 | 6856 |
| 144 | S | G | Y | G | G | I | L | L | V | 11 | 6857 |
| 166 | N | C | D | Q | H | V | H | C | L | 11 | 6858 |
| 169 | Q | H | V | H | C | L | Q | D | L | 11 | 6859 |
| 172 | H | C | L | Q | D | L | E | D | M | 11 | 6860 |
| 175 | Q | D | L | E | D | M | S | V | M | 11 | 6861 |
| 177 | L | E | D | M | S | V | M | V | L | 11 | 6862 |
| 193 | L | F | D | D | H | K | L | V | L | 11 | 6863 |
| 246 | E | E | R | F | F | V | E | G | L | 11 | 6864 |
| 253 | G | L | S | F | P | D | A | G | F | 11 | 6865 |
| 259 | A | G | F | T | G | L | I | S | F | 11 | 6866 |
| 264 | L | I | S | F | H | V | T | L | L | 11 | 6867 |
| 291 | F | R | V | A | P | W | I | M | T | 11 | 6868 |
| 295 | P | W | I | M | T | P | S | T | L | 11 | 6869 |
| 327 | A | R | K | A | G | C | K | L | T | 11 | 6870 |
| 342 | N | R | N | D | R | W | I | Q | D | 11 | 6871 |
| 368 | F | D | S | P | R | N | G | E | L | 11 | 6872 |
| 384 | I | L | G | P | D | F | G | Y | V | 11 | 6873 |
| 398 | D | R | S | V | S | G | L | D | S | 11 | 6874 |
| 417 | V | A | N | G | K | E | Y | P | L | 11 | 6875 |
| 446 | V | R | D | F | L | H | A | Q | K | 11 | 6876 |
| 458 | P | V | E | L | F | V | D | W | L | 11 | 6877 |
| 467 | A | V | G | H | V | D | E | F | L | 11 | 6878 |
| 486 | F | R | M | L | L | A | S | P | G | 11 | 6879 |
| 491 | A | S | P | G | A | C | F | K | L | 11 | 6880 |
| 515 | Q | G | V | V | D | D | E | Q | V | 11 | 6881 |
| 529 | N | Q | V | L | S | N | K | D | L | 11 | 6882 |
| 530 | Q | V | L | S | N | K | D | L | I | 11 | 6883 |
| 583 | F | F | P | D | L | V | N | M | L | 11 | 6884 |
| 591 | L | V | L | G | K | H | L | G | I | 11 | 6885 |
| 598 | G | I | P | K | P | F | G | P | I | 11 | 6886 |
| 599 | I | P | K | P | F | G | P | I | I | 11 | 6887 |
| 605 | P | I | I | N | G | C | C | C | L | 11 | 6888 |
| 609 | G | C | C | C | L | E | E | K | V | 11 | 6889 |
| 612 | C | L | E | E | K | V | R | S | L | 11 | 6890 |
| 617 | V | R | S | L | L | E | P | L | G | 11 | 6891 |
| 647 | G | T | N | V | C | R | K | P | F | 11 | 6892 |
| 651 | C | R | K | P | F | S | F | K | W | 11 | 6893 |
| 12 | E | H | P | T | S | A | V | C | V | 10 | 6894 |
| 25 | T | L | V | D | I | Y | G | S | V | 10 | 6895 |
| 40 | F | E | V | Y | G | T | P | G | V | 10 | 6896 |
| 57 | E | R | G | R | E | R | A | D | T | 10 | 6897 |
| 61 | E | R | A | D | T | R | R | W | R | 10 | 6898 |
| 65 | T | R | R | W | R | F | D | A | T | 10 | 6899 |
| 86 | D | L | N | D | S | H | V | Q | I | 10 | 6900 |
| 102 | P | L | P | L | A | Y | A | V | L | 10 | 6901 |
| 143 | P | S | G | Y | G | G | I | L | L | 10 | 6902 |
| 208 | A | K | R | A | Q | V | F | H | I | 10 | 6903 |
| 222 | V | C | E | A | Y | R | H | V | L | 10 | 6904 |
| 226 | Y | R | H | V | L | G | Q | D | K | 10 | 6905 |
| 256 | F | P | D | A | G | F | T | G | L | 10 | 6906 |
| 285 | F | T | D | T | V | V | F | R | V | 10 | 6907 |
| 300 | P | S | T | L | P | P | L | E | V | 10 | 6908 |
| 302 | T | L | P | P | L | E | V | Y | V | 10 | 6909 |
| 305 | P | L | E | V | Y | V | C | R | V | 10 | 6910 |
| 313 | V | R | N | N | T | C | F | V | D | 10 | 6911 |
| 315 | N | N | T | C | F | V | D | A | V | 10 | 6912 |
| 326 | L | A | R | K | A | G | C | K | L | 10 | 6913 |
| 345 | D | R | W | I | Q | D | E | M | E | 10 | 6914 |
| 356 | Y | V | Q | A | P | H | K | T | L | 10 | 6915 |
| 359 | A | P | H | K | T | L | P | V | V | 10 | 6916 |
| 434 | L | P | G | S | S | G | R | R | V | 10 | 6917 |
| 437 | S | S | G | R | R | V | T | Q | V | 10 | 6918 |
| 442 | V | T | Q | V | V | R | D | F | L | 10 | 6919 |
| 455 | V | Q | P | P | V | E | L | F | V | 10 | 6920 |
| 466 | L | A | V | G | H | V | D | E | F | 10 | 6921 |
| 478 | V | P | A | P | D | G | K | G | F | 10 | 6922 |
| 480 | A | P | D | G | K | G | F | R | M | 10 | 6923 |
| 481 | P | D | G | K | G | F | R | M | L | 10 | 6924 |
| 482 | D | G | K | G | F | R | M | L | L | 10 | 6925 |
| 504 | Q | K | C | G | H | G | R | A | L | 10 | 6926 |
| 506 | C | G | H | G | R | A | L | L | F | 10 | 6927 |
| 523 | V | K | T | I | S | I | N | Q | V | 10 | 6928 |
| 547 | C | I | D | W | N | R | E | V | L | 10 | 6929 |
| 559 | L | G | L | A | E | C | D | I | I | 10 | 6930 |
| 565 | D | I | I | D | I | P | Q | L | F | 10 | 6931 |
| 613 | L | E | E | K | V | R | S | L | L | 10 | 6932 |
| 622 | E | P | L | G | L | H | C | T | F | 10 | 6933 |
| 631 | I | D | D | F | T | P | Y | H | M | 10 | 6934 |
| 655 | F | S | F | K | W | W | N | M | V | 10 | 6935 |
| 15 | T | S | A | V | C | V | A | G | V | 9 | 6936 |
| 42 | V | Y | G | T | P | G | V | D | I | 9 | 6937 |
| 71 | D | A | T | L | E | I | I | V | V | 9 | 6938 |
| 107 | Y | A | V | L | Y | L | T | C | V | 9 | 6939 |
| 125 | C | E | G | R | Q | D | R | N | F | 9 | 6940 |
| 126 | E | G | R | Q | D | R | N | F | V | 9 | 6941 |
| 132 | N | F | V | D | K | R | Q | W | V | 9 | 6942 |
| 141 | W | G | P | S | G | Y | G | G | I | 9 | 6943 |
| 176 | D | L | E | D | M | S | V | M | V | 9 | 6944 |
| 205 | S | Y | D | A | K | R | A | Q | V | 9 | 6945 |
| 206 | Y | D | A | K | R | A | Q | V | F | 9 | 6946 |
| 214 | F | H | I | C | G | P | E | D | V | 9 | 6947 |
| 261 | F | T | G | L | I | S | F | H | V | 9 | 6948 |
| 276 | N | E | D | F | S | A | S | P | I | 9 | 6949 |
| 281 | A | S | P | I | F | T | D | T | V | 9 | 6950 |
| 282 | S | P | I | F | T | D | T | V | V | 9 | 6951 |
| 340 | A | E | N | R | N | D | R | W | I | 9 | 6952 |
| 344 | N | D | R | W | I | Q | D | E | M | 9 | 6953 |
| 358 | Q | A | P | H | K | T | L | P | V | 9 | 6954 |
| 360 | P | H | K | T | L | P | V | V | 9 | 6955 |
| 376 | L | Q | D | F | P | Y | K | R | I | 9 | 6956 |
| 381 | Y | K | R | I | L | G | P | D | F | 9 | 6957 |
| 404 | D | D | S | F | G | N | L | E | V | 9 | 6958 |
| 409 | N | L | E | V | S | P | P | V | V | 9 | 6959 |
| 451 | H | A | Q | K | V | Q | P | P | V | 9 | 6960 |
| 463 | V | D | W | L | A | V | G | H | V | 9 | 6961 |
| 489 | L | L | A | S | P | G | A | C | F | 9 | 6962 |
| 518 | V | D | D | E | Q | V | K | T | I | 9 | 6963 |
| 536 | D | L | I | N | Y | N | K | F | V | 9 | 6964 |
| 546 | S | C | I | D | W | N | R | E | V | 9 | 6965 |
| 561 | L | A | E | C | D | I | I | D | I | 9 | 6966 |
| 575 | T | E | R | K | K | A | T | A | F | 9 | 6967 |
| 580 | A | T | A | F | F | P | D | L | V | 9 | 6968 |
| 654 | P | F | S | F | K | W | W | N | M | 9 | 6969 |
| 10 | S | L | E | H | P | T | S | A | V | 8 | 6970 |
| 19 | C | V | A | G | V | E | T | L | V | 8 | 6971 |
| 32 | S | V | P | E | G | T | E | M | F | 8 | 6972 |
| 34 | P | E | G | T | E | M | F | E | V | 8 | 6973 |
| 70 | P | D | A | T | L | E | I | I | V | 8 | 6974 |
| 84 | S | N | D | L | N | D | S | H | V | 8 | 6975 |
| 131 | R | N | F | V | D | K | R | Q | W | 8 | 6976 |
| 163 | V | Q | D | N | C | D | Q | H | V | 8 | 6977 |
| 174 | L | Q | D | L | E | D | M | S | V | 8 | 6978 |
| 221 | D | V | C | E | A | Y | R | H | V | 8 | 6979 |

TABLE XXXII-continued

| Pos | 1 | 2 | 3 | 4 | 5 | 6 | 7 | 8 | 9 | score | SEQ. ID NO. |
|---|---|---|---|---|---|---|---|---|---|---|---|
| 242 | L | H | G | D | E | E | R | F | F | 8 | 6980 |
| 243 | H | G | D | E | E | R | F | F | V | 8 | 6981 |
| 257 | P | D | A | G | F | T | G | L | I | 8 | 6982 |
| 271 | L | L | D | D | S | N | E | D | F | 8 | 6983 |
| 290 | V | F | R | V | A | P | W | I | M | 8 | 6984 |
| 349 | Q | D | E | M | E | L | G | Y | V | 8 | 6985 |
| 422 | E | Y | P | L | G | R | I | L | I | 8 | 6986 |
| 438 | S | G | R | R | V | T | Q | V | V | 8 | 6987 |
| 470 | H | V | D | E | F | L | S | F | V | 8 | 6988 |
| 492 | S | P | G | A | C | F | K | L | F | 8 | 6989 |
| 520 | D | E | Q | V | K | T | I | S | I | 8 | 6990 |
| 540 | Y | N | K | F | V | Q | S | C | I | 8 | 6991 |
| 558 | E | L | G | L | A | E | C | D | I | 8 | 6992 |
| 584 | F | P | D | L | V | N | M | L | V | 8 | 6993 |
| 623 | P | L | G | L | H | C | T | F | I | 8 | 6994 |
| 626 | L | H | C | T | F | I | D | D | F | 8 | 6995 |
| 636 | P | Y | H | M | L | H | G | E | V | 8 | 6996 |
| 649 | N | V | C | R | K | P | F | S | F | 8 | 6997 |
| 374 | G | E | L | Q | D | F | P | Y | K | 7 | 6998 |
| 487 | R | M | L | L | A | S | P | G | A | 7 | 6999 |
| 557 | R | E | L | G | L | A | E | C | D | 7 | 7000 |
| 5 | R | I | V | R | V | S | L | E | H | 6 | 7001 |
| 60 | R | E | R | A | D | T | R | R | W | 6 | 7002 |
| 67 | R | W | R | F | D | A | T | L | E | 6 | 7003 |
| 362 | K | T | L | P | V | V | F | D | S | 6 | 7004 |
| 383 | R | I | L | G | P | P | D | F | G | 6 | 7005 |
| 390 | G | Y | V | T | R | E | P | R | D | 6 | 7006 |
| 427 | R | I | L | I | G | G | N | L | P | 6 | 7007 |
| 432 | G | N | L | P | G | S | S | G | R | 6 | 7008 |
| 8 | R | V | S | L | E | H | P | T | S | 5 | 7009 |
| 58 | R | G | R | E | R | A | D | T | R | 5 | 7010 |
| 117 | I | S | L | D | C | D | L | N | C | 5 | 7011 |
| 128 | R | Q | D | R | N | F | V | D | K | 5 | 7012 |
| 137 | R | Q | W | V | W | G | P | S | G | 5 | 7013 |
| 145 | G | Y | G | G | I | L | L | V | N | 5 | 7014 |
| 147 | G | G | I | L | L | V | N | C | D | 5 | 7015 |
| 148 | G | I | L | L | V | N | C | D | R | 5 | 7016 |
| 156 | R | D | D | P | S | C | D | V | Q | 5 | 7017 |
| 254 | L | S | F | P | D | A | G | F | T | 5 | 7018 |
| 292 | R | V | A | P | W | I | M | T | P | 5 | 7019 |
| 314 | R | N | N | T | C | F | V | D | A | 5 | 7020 |
| 317 | T | C | F | V | D | A | V | A | E | 5 | 7021 |
| 332 | C | K | L | T | I | C | P | Q | A | 5 | 7022 |
| 394 | R | E | P | R | D | R | S | V | S | 5 | 7023 |
| 397 | R | D | R | S | V | S | G | L | D | 5 | 7024 |
| 473 | E | F | L | S | F | V | P | A | P | 5 | 7025 |
| 484 | K | G | F | R | M | L | L | A | S | 5 | 7026 |
| 516 | G | V | V | D | D | E | Q | V | K | 5 | 7027 |
| 538 | I | N | Y | N | K | F | V | Q | S | 5 | 7028 |
| 552 | R | E | V | L | K | R | E | L | G | 5 | 7029 |
| 577 | R | K | K | A | T | A | F | F | P | 5 | 7030 |
| 601 | K | P | F | G | P | I | I | N | G | 5 | 7031 |
| 653 | K | P | F | S | F | K | W | W | N | 5 | 7032 |
| 22 | G | V | E | T | L | V | D | I | Y | 4 | 7033 |
| 24 | E | T | L | V | D | I | Y | G | S | 4 | 7034 |
| 28 | D | I | Y | G | S | V | P | E | G | 4 | 7035 |
| 36 | G | T | E | M | F | E | V | Y | G | 4 | 7036 |
| 103 | L | P | L | A | Y | A | V | L | Y | 4 | 7037 |
| 149 | I | L | L | V | N | C | D | R | D | 4 | 7038 |
| 210 | R | A | Q | V | F | H | I | C | G | 4 | 7039 |
| 220 | E | D | V | C | E | A | Y | R | H | 4 | 7040 |
| 224 | E | A | Y | R | H | V | L | G | Q | 4 | 7041 |
| 260 | G | F | T | G | L | I | S | F | H | 4 | 7042 |
| 265 | I | S | F | H | V | T | L | L | D | 4 | 7043 |
| 269 | V | T | L | L | D | D | S | N | E | 4 | 7044 |
| 284 | I | F | T | D | T | V | V | F | R | 4 | 7045 |
| 297 | I | M | T | P | S | T | L | P | P | 4 | 7046 |
| 307 | E | V | Y | V | C | R | V | R | N | 4 | 7047 |
| 343 | R | N | D | R | W | I | Q | D | E | 4 | 7048 |
| 354 | L | G | Y | V | Q | A | P | H | K | 4 | 7049 |
| 355 | G | Y | V | Q | A | P | H | K | T | 4 | 7050 |
| 365 | P | V | V | F | D | S | P | R | N | 4 | 7051 |
| 372 | R | N | G | E | L | Q | D | F | P | 4 | 7052 |
| 386 | G | P | D | F | G | Y | V | T | R | 4 | 7053 |
| 387 | P | D | F | G | Y | V | T | R | E | 4 | 7054 |
| 403 | G | L | D | S | F | G | N | L | E | 4 | 7055 |
| 436 | G | S | S | G | R | R | V | T | Q | 4 | 7056 |
| 475 | L | S | F | V | P | A | P | D | G | 4 | 7057 |
| 483 | G | K | G | F | R | M | L | L | A | 4 | 7058 |
| 494 | G | A | C | F | K | L | F | Q | E | 4 | 7059 |
| 498 | K | L | F | Q | E | K | Q | K | C | 4 | 7060 |
| 507 | G | H | G | R | A | L | L | F | Q | 4 | 7061 |
| 511 | A | L | L | F | Q | G | V | V | D | 4 | 7062 |
| 512 | L | L | F | Q | G | V | V | D | D | 4 | 7063 |
| 526 | I | S | I | N | Q | V | L | S | N | 4 | 7064 |
| 594 | G | K | H | L | G | I | P | K | P | 4 | 7065 |
| 604 | G | P | I | I | N | G | C | C | C | 4 | 7066 |
| 611 | C | C | L | E | E | K | V | R | S | 4 | 7067 |
| 652 | R | K | P | F | S | F | K | W | W | 4 | 7068 |
| 13 | H | P | T | S | A | V | C | V | A | 3 | 7069 |
| 43 | Y | G | T | P | G | V | D | I | Y | 3 | 7070 |
| 47 | G | V | D | I | Y | I | S | P | N | 3 | 7071 |
| 50 | I | Y | I | S | P | N | M | E | R | 3 | 7072 |
| 73 | T | L | E | I | I | V | V | M | N | 3 | 7073 |
| 74 | L | E | I | I | V | V | M | N | S | 3 | 7074 |
| 77 | I | V | V | M | N | S | P | S | N | 3 | 7075 |
| 81 | N | S | P | S | N | D | L | N | D | 3 | 7076 |
| 85 | N | D | L | N | D | S | H | V | Q | 3 | 7077 |
| 90 | S | H | V | Q | I | S | Y | H | S | 3 | 7078 |
| 94 | I | S | Y | H | S | S | H | E | P | 3 | 7079 |
| 105 | L | A | Y | A | V | L | Y | L | T | 3 | 7080 |
| 108 | A | V | L | Y | L | T | C | V | D | 3 | 7081 |
| 110 | L | Y | L | T | C | V | D | I | S | 3 | 7082 |
| 113 | T | C | V | D | I | S | L | D | C | 3 | 7083 |
| 121 | C | D | L | N | C | E | G | R | Q | 3 | 7084 |
| 157 | D | D | P | S | C | D | V | Q | D | 3 | 7085 |
| 179 | D | M | S | V | M | V | L | R | T | 3 | 7086 |
| 187 | T | Q | G | P | A | A | L | F | D | 3 | 7087 |
| 189 | G | P | A | A | L | F | D | D | H | 3 | 7088 |
| 198 | K | V | L | V | L | H | T | S | S | Y | 3 | 7089 |
| 203 | T | S | S | Y | D | A | K | R | A | 3 | 7090 |
| 212 | Q | V | F | H | I | C | G | P | E | 3 | 7091 |
| 216 | I | C | G | P | E | D | V | C | E | 3 | 7092 |
| 218 | G | P | E | D | V | C | E | A | Y | 3 | 7093 |
| 233 | D | K | V | S | Y | E | V | P | R | 3 | 7094 |
| 244 | G | D | E | E | R | F | F | V | E | 3 | 7095 |
| 252 | E | G | L | S | F | P | D | A | G | 3 | 7096 |
| 270 | T | L | L | D | D | S | N | E | D | 3 | 7097 |
| 301 | S | T | L | P | P | L | E | V | Y | 3 | 7098 |
| 304 | P | P | L | E | V | Y | V | C | R | 3 | 7099 |
| 308 | V | Y | V | C | R | V | R | N | N | 3 | 7100 |
| 324 | A | E | L | A | R | K | A | G | C | 3 | 7101 |
| 331 | G | C | K | L | T | I | C | P | Q | 3 | 7102 |
| 333 | K | L | T | I | C | P | Q | A | E | 3 | 7103 |
| 335 | T | I | C | P | Q | A | E | N | R | 3 | 7104 |
| 352 | M | E | L | G | Y | V | Q | A | P | 3 | 7105 |
| 361 | H | K | T | L | P | V | V | F | D | 3 | 7106 |
| 366 | V | V | F | D | S | P | R | N | G | 3 | 7107 |
| 379 | F | P | Y | K | R | I | L | G | P | 3 | 7108 |
| 410 | L | E | V | S | P | P | V | V | A | 3 | 7109 |
| 411 | E | V | S | P | P | V | V | A | N | 3 | 7110 |
| 412 | V | S | P | P | V | V | A | N | G | 3 | 7111 |
| 423 | Y | P | L | G | R | I | L | I | G | 3 | 7112 |
| 428 | I | L | I | G | G | N | L | P | G | 3 | 7113 |
| 431 | G | G | N | L | P | G | S | S | G | 3 | 7114 |
| 444 | Q | V | V | R | D | F | L | H | A | 3 | 7115 |
| 472 | D | E | F | L | S | F | V | P | A | 3 | 7116 |
| 485 | G | F | R | M | L | L | A | S | P | 3 | 7117 |
| 495 | A | C | F | K | L | F | Q | E | K | 3 | 7118 |
| 497 | F | K | L | F | Q | E | K | Q | K | 3 | 7119 |
| 503 | K | Q | K | C | G | H | G | R | A | 3 | 7120 |
| 534 | N | K | D | L | I | N | Y | N | K | 3 | 7121 |
| 542 | K | F | V | Q | S | C | I | D | W | 3 | 7122 |
| 560 | G | L | A | E | C | D | I | I | D | 3 | 7123 |
| 567 | I | D | I | P | Q | L | F | K | T | 3 | 7124 |
| 570 | P | Q | L | F | K | T | E | R | K | 3 | 7125 |
| 581 | T | A | F | F | P | D | L | V | N | 3 | 7126 |
| 625 | G | L | H | C | T | F | I | D | D | 3 | 7127 |
| 628 | C | T | F | I | D | D | F | T | P | 3 | 7128 |
| 638 | H | M | L | H | G | E | V | H | C | 3 | 7129 |
| 2 | S | L | Q | R | I | V | R | V | S | 2 | 7130 |
| 9 | V | S | L | E | H | P | T | S | A | 2 | 7131 |

TABLE XXXII-continued

| Pos | 1 | 2 | 3 | 4 | 5 | 6 | 7 | 8 | 9 | score | SEQ. ID NO. |
|---|---|---|---|---|---|---|---|---|---|---|---|
| 16 | S | A | V | C | V | A | G | V | E | 2 | 7132 |
| 17 | A | V | C | V | A | G | V | E | T | 2 | 7133 |
| 27 | V | D | I | Y | G | S | V | P | E | 2 | 7134 |
| 29 | I | Y | G | S | V | P | E | G | T | 2 | 7135 |
| 37 | T | E | M | F | E | V | Y | G | T | 2 | 7136 |
| 38 | E | M | F | E | V | Y | G | T | P | 2 | 7137 |
| 41 | E | V | Y | G | T | P | G | V | D | 2 | 7138 |
| 45 | T | P | G | V | D | I | Y | I | S | 2 | 7139 |
| 46 | P | G | V | D | I | Y | I | S | P | 2 | 7140 |
| 49 | D | I | Y | I | S | P | N | M | E | 2 | 7141 |
| 51 | Y | I | S | P | N | M | E | R | G | 2 | 7142 |
| 63 | A | D | T | R | R | W | R | F | D | 2 | 7143 |
| 76 | I | I | V | V | M | N | S | P | S | 2 | 7144 |
| 87 | L | N | D | S | H | V | Q | I | S | 2 | 7145 |
| 92 | V | Q | I | S | Y | H | S | S | H | 2 | 7146 |
| 96 | Y | H | S | S | H | E | P | L | P | 2 | 7147 |
| 99 | S | H | E | P | L | P | L | A | Y | 2 | 7148 |
| 106 | A | Y | A | V | L | Y | L | T | C | 2 | 7149 |
| 140 | V | W | G | P | S | G | Y | G | G | 2 | 7150 |
| 146 | Y | G | G | I | L | L | V | N | C | 2 | 7151 |
| 153 | N | C | D | R | D | D | P | S | C | 2 | 7152 |
| 158 | D | P | S | C | D | V | Q | D | N | 2 | 7153 |
| 161 | C | D | V | Q | D | N | C | D | Q | 2 | 7154 |
| 168 | D | Q | H | V | H | C | L | Q | D | 2 | 7155 |
| 178 | E | D | M | S | V | M | V | L | R | 2 | 7156 |
| 183 | M | V | L | R | T | Q | G | P | A | 2 | 7157 |
| 195 | D | D | H | K | L | V | L | H | T | 2 | 7158 |
| 197 | H | K | L | V | L | H | T | S | S | 2 | 7159 |
| 199 | L | V | L | H | T | S | S | Y | D | 2 | 7160 |
| 201 | L | H | T | S | S | Y | D | A | K | 2 | 7161 |
| 204 | S | S | Y | D | A | K | R | A | Q | 2 | 7162 |
| 211 | A | Q | V | F | H | I | C | G | F | 2 | 7163 |
| 217 | C | G | P | E | D | V | C | E | A | 2 | 7164 |
| 225 | A | Y | R | H | V | L | G | Q | D | 2 | 7165 |
| 228 | H | V | L | G | Q | D | K | V | S | 2 | 7166 |
| 229 | V | L | G | Q | D | K | V | S | Y | 2 | 7167 |
| 235 | V | S | Y | E | V | P | R | L | H | 2 | 7168 |
| 237 | Y | E | V | P | R | L | H | G | D | 2 | 7169 |
| 262 | T | G | L | I | S | F | H | V | T | 2 | 7170 |
| 280 | S | A | S | P | I | F | T | D | T | 2 | 7171 |
| 287 | D | T | V | V | F | R | V | A | P | 2 | 7172 |
| 288 | T | V | V | F | R | V | A | P | W | 2 | 7173 |
| 294 | A | P | W | I | M | T | P | S | T | 2 | 7174 |
| 303 | L | P | P | L | E | V | Y | V | C | 2 | 7175 |
| 321 | D | A | V | A | E | L | A | R | K | 2 | 7176 |
| 322 | A | V | A | E | L | A | R | K | A | 2 | 7177 |
| 329 | K | A | G | C | K | L | T | I | C | 2 | 7178 |
| 336 | I | C | P | Q | A | E | N | R | N | 2 | 7179 |
| 348 | I | Q | D | E | M | E | L | G | Y | 2 | 7180 |
| 351 | E | M | E | L | G | Y | V | Q | A | 2 | 7181 |
| 370 | S | P | R | N | G | E | L | Q | D | 2 | 7182 |
| 389 | F | G | Y | V | T | R | E | P | R | 2 | 7183 |
| 405 | D | S | F | G | N | L | E | V | S | 2 | 7184 |
| 418 | A | N | G | K | E | Y | P | L | G | 2 | 7185 |
| 448 | D | F | L | H | A | Q | K | V | Q | 2 | 7186 |
| 449 | F | L | H | A | Q | K | V | Q | P | 2 | 7187 |
| 452 | A | Q | K | V | Q | P | P | V | E | 2 | 7188 |
| 457 | P | P | V | E | L | F | V | D | W | 2 | 7189 |
| 459 | V | E | L | F | V | D | W | L | A | 2 | 7190 |
| 462 | F | V | D | W | L | A | V | G | H | 2 | 7191 |
| 464 | D | W | L | A | V | G | H | V | D | 2 | 7192 |
| 476 | S | F | V | P | A | P | D | G | K | 2 | 7193 |
| 488 | M | L | L | A | S | P | G | A | C | 2 | 7194 |
| 490 | L | A | S | P | G | A | C | F | K | 2 | 7195 |
| 522 | Q | V | K | T | I | S | I | N | Q | 2 | 7196 |
| 532 | L | S | N | K | D | L | I | N | Y | 2 | 7197 |
| 541 | N | K | F | V | Q | S | C | I | D | 2 | 7198 |
| 544 | V | Q | S | C | I | D | W | N | R | 2 | 7199 |
| 545 | Q | S | C | I | D | W | N | R | E | 2 | 7200 |
| 548 | I | D | W | N | R | E | V | L | K | 2 | 7201 |
| 549 | D | W | N | R | E | V | L | K | R | 2 | 7202 |
| 562 | A | E | C | D | I | E | I | D | P | 2 | 7203 |
| 566 | I | I | D | I | P | Q | D | L | F | 2 | 7204 |
| 571 | Q | L | F | K | T | E | R | K | K | 2 | 7205 |
| 574 | K | T | E | R | K | K | A | T | A | 2 | 7206 |
| 578 | K | K | A | T | A | F | F | P | D | 2 | 7207 |
| 586 | D | L | V | N | M | L | V | L | G | 2 | 7208 |
| 587 | L | V | N | M | L | V | L | G | K | 2 | 7209 |
| 597 | L | G | I | P | K | P | F | G | P | 2 | 7210 |
| 602 | P | F | G | P | I | I | N | G | C | 2 | 7211 |
| 607 | I | N | G | C | C | C | L | E | E | 2 | 7212 |
| 615 | E | K | V | R | S | L | L | E | P | 2 | 7213 |
| 619 | S | L | L | E | P | L | G | L | H | 2 | 7214 |
| 620 | L | L | E | P | L | G | L | H | C | 2 | 7215 |
| 624 | L | G | L | H | C | T | F | I | D | 2 | 7216 |
| 627 | H | C | T | F | I | D | D | F | T | 2 | 7217 |
| 629 | T | F | I | D | D | F | T | P | Y | 2 | 7218 |
| 633 | D | F | T | P | Y | H | M | L | H | 2 | 7219 |
| 635 | T | P | Y | H | M | L | H | G | E | 2 | 7220 |
| 645 | H | C | G | T | N | V | C | R | K | 2 | 7221 |
| 648 | T | N | V | C | R | K | P | F | S | 2 | 7222 |
| 6 | I | V | R | V | S | L | E | H | P | 1 | 7223 |
| 11 | L | E | H | P | T | S | A | V | C | 1 | 7224 |
| 14 | P | T | S | A | V | C | V | A | G | 1 | 7225 |
| 20 | V | A | G | V | E | T | L | V | D | 1 | 7226 |
| 23 | V | E | T | L | V | D | I | Y | G | 1 | 7227 |
| 35 | E | G | T | E | M | F | E | V | Y | 1 | 7228 |
| 52 | I | S | P | N | M | E | R | G | R | 1 | 7229 |
| 53 | S | P | N | M | E | R | G | R | E | 1 | 7230 |
| 55 | N | M | E | R | G | R | E | R | A | 1 | 7231 |
| 75 | E | I | I | V | V | M | N | S | P | 1 | 7232 |
| 78 | V | V | M | N | S | P | S | N | D | 1 | 7233 |
| 80 | M | N | S | P | S | N | D | L | N | 1 | 7234 |
| 82 | S | P | S | N | D | L | N | D | S | 1 | 7235 |
| 98 | S | S | H | E | P | L | P | L | A | 1 | 7236 |
| 112 | L | T | C | V | D | I | S | L | D | 1 | 7237 |
| 116 | D | I | S | L | D | C | D | L | N | 1 | 7238 |
| 118 | S | L | D | C | D | L | N | C | E | 1 | 7239 |
| 122 | D | L | N | C | E | G | R | Q | D | 1 | 7240 |
| 124 | N | C | E | G | R | Q | D | R | N | 1 | 7241 |
| 129 | Q | D | R | N | F | V | D | K | R | 1 | 7242 |
| 134 | V | D | K | R | Q | W | V | W | G | 1 | 7243 |
| 135 | D | K | R | Q | W | V | W | G | P | 1 | 7244 |
| 138 | Q | W | V | W | G | P | S | G | Y | 1 | 7245 |
| 150 | L | L | V | N | C | D | R | D | D | 1 | 7246 |
| 151 | L | V | N | C | D | R | D | D | P | 1 | 7247 |
| 154 | C | D | R | D | D | P | S | C | D | 1 | 7248 |
| 159 | P | S | C | D | V | Q | D | N | C | 1 | 7249 |
| 162 | D | V | Q | D | N | C | D | Q | H | 1 | 7250 |
| 164 | Q | D | N | C | D | Q | H | V | H | 1 | 7251 |
| 165 | D | N | C | D | Q | H | V | H | C | 1 | 7252 |
| 171 | V | H | C | L | Q | D | L | E | D | 1 | 7253 |
| 180 | M | S | V | M | V | L | R | T | Q | 1 | 7254 |
| 181 | S | V | M | V | L | R | T | Q | G | 1 | 7255 |
| 182 | V | M | V | L | R | T | Q | G | P | 1 | 7256 |
| 184 | V | L | R | T | Q | G | P | A | A | 1 | 7257 |
| 194 | F | D | D | H | K | L | V | L | H | 1 | 7258 |
| 200 | V | L | H | T | S | S | Y | D | A | 1 | 7259 |
| 202 | H | T | S | S | Y | D | A | K | R | 1 | 7260 |
| 207 | D | A | K | R | A | Q | V | F | H | 1 | 7261 |
| 213 | V | F | H | I | C | G | F | E | D | 1 | 7262 |
| 223 | C | E | A | Y | R | H | V | L | G | 1 | 7263 |
| 230 | L | G | Q | D | K | V | S | Y | E | 1 | 7264 |
| 236 | S | Y | E | V | P | R | L | H | G | 1 | 7265 |
| 245 | D | E | E | R | F | F | V | E | G | 1 | 7266 |
| 249 | F | F | V | E | G | L | S | F | P | 1 | 7267 |
| 251 | V | E | G | L | S | F | P | D | A | 1 | 7268 |
| 258 | D | A | G | F | T | G | L | I | S | 1 | 7269 |
| 266 | S | F | H | V | T | L | L | D | D | 1 | 7270 |
| 267 | F | H | V | T | L | L | D | D | S | 1 | 7271 |
| 268 | H | V | T | L | L | D | D | S | N | 1 | 7272 |
| 272 | L | D | D | S | N | E | D | F | S | 1 | 7273 |
| 274 | D | D | S | N | E | D | F | S | A | 1 | 7274 |
| 279 | F | S | A | S | P | I | F | T | D | 1 | 7275 |
| 286 | T | D | T | V | V | F | R | V | A | 1 | 7276 |
| 293 | V | A | P | W | I | M | T | P | S | 1 | 7277 |
| 299 | T | P | S | T | L | P | P | L | E | 1 | 7278 |
| 306 | L | E | V | Y | V | C | R | V | R | 1 | 7279 |
| 309 | Y | V | C | R | V | R | N | N | T | 1 | 7280 |
| 319 | F | V | D | A | V | A | E | L | A | 1 | 7281 |
| 320 | V | D | A | V | A | E | L | A | R | 1 | 7282 |
| 325 | E | L | A | R | K | A | G | C | K | 1 | 7283 |

TABLE XXXII-continued

| Pos | 1 | 2 | 3 | 4 | 5 | 6 | 7 | 8 | 9 | score | SEQ. ID NO. |
|---|---|---|---|---|---|---|---|---|---|---|---|
| 330 | A | G | C | K | L | T | I | C | P | 1 | 7284 |
| 334 | L | T | I | C | P | Q | A | E | N | 1 | 7285 |
| 337 | C | P | Q | A | E | N | R | N | D | 1 | 7286 |
| 339 | Q | A | E | N | R | N | D | R | W | 1 | 7287 |
| 341 | E | N | R | N | D | R | W | I | Q | 1 | 7288 |
| 350 | D | E | M | E | L | G | Y | V | Q | 1 | 7289 |
| 357 | V | Q | A | P | H | K | T | L | P | 1 | 7230 |
| 364 | L | P | V | V | F | D | S | P | R | 1 | 7291 |
| 367 | V | F | D | S | P | R | N | G | E | 1 | 7292 |
| 375 | E | L | Q | D | F | P | Y | K | R | 1 | 7293 |
| 380 | P | Y | K | R | I | L | G | P | D | 1 | 7294 |
| 385 | L | G | P | D | F | G | Y | V | T | 1 | 7295 |
| 391 | Y | V | T | R | E | P | R | D | R | 1 | 7296 |
| 392 | V | T | R | E | P | R | D | R | S | 1 | 7297 |
| 395 | E | P | R | D | R | S | V | S | G | 1 | 7298 |
| 401 | V | S | G | L | D | S | F | G | N | 1 | 7299 |
| 406 | S | F | G | N | L | E | V | S | P | 1 | 7300 |
| 407 | F | G | N | L | E | V | S | P | P | 1 | 7301 |
| 413 | S | P | P | V | V | A | N | G | K | 1 | 7302 |
| 414 | P | P | V | V | A | N | G | K | E | 1 | 7303 |
| 415 | P | V | V | A | N | G | K | E | Y | 1 | 7304 |
| 419 | N | G | K | E | Y | P | L | G | R | 1 | 7305 |
| 424 | P | L | G | R | I | L | I | G | G | 1 | 7306 |
| 429 | L | I | G | G | N | L | P | G | S | 1 | 7307 |
| 430 | I | G | G | N | L | P | G | S | S | 1 | 7308 |
| 433 | N | L | P | G | S | S | G | R | R | 1 | 7309 |
| 435 | P | G | S | S | G | R | R | V | T | 1 | 7310 |
| 443 | T | Q | V | V | R | D | F | L | H | 1 | 7311 |
| 450 | L | H | A | Q | K | V | Q | P | P | 1 | 7312 |
| 461 | L | F | V | D | W | L | A | V | G | 1 | 7313 |
| 465 | W | L | A | V | G | H | V | D | E | 1 | 7314 |
| 468 | V | G | H | V | D | E | F | L | S | 1 | 7315 |
| 493 | P | G | A | C | F | K | L | F | Q | 1 | 7316 |
| 508 | H | G | R | A | L | L | F | Q | G | 1 | 7317 |
| 513 | L | F | Q | G | V | V | D | D | E | 1 | 7318 |
| 517 | V | D | D | E | Q | V | K | T | | 1 | 7319 |
| 521 | E | Q | V | K | T | I | S | I | N | 1 | 7320 |
| 525 | T | I | S | I | N | Q | V | L | S | 1 | 7321 |
| 527 | S | I | N | Q | V | L | S | N | K | 1 | 7322 |
| 528 | I | N | Q | V | L | S | N | K | D | 1 | 7323 |
| 531 | V | L | S | N | K | D | L | I | N | 1 | 7324 |
| 539 | N | Y | N | K | F | V | Q | S | C | 1 | 7325 |
| 543 | F | V | Q | S | C | I | D | W | N | 1 | 7326 |
| 550 | W | N | R | E | V | L | K | R | E | 1 | 7327 |
| 555 | L | K | R | E | L | G | L | A | E | 1 | 7328 |
| 563 | E | C | D | I | I | D | I | P | Q | 1 | 7329 |
| 569 | I | P | Q | L | F | K | T | E | R | 1 | 7330 |
| 573 | F | K | T | E | R | K | K | A | T | 1 | 7331 |
| 590 | M | L | V | L | G | K | H | L | G | 1 | 7332 |
| 596 | H | L | G | I | P | K | P | F | G | 1 | 7333 |
| 603 | F | G | P | I | I | N | G | C | C | 1 | 7334 |
| 606 | I | I | N | G | C | C | C | L | E | 1 | 7335 |
| 614 | E | E | K | V | R | S | L | L | E | 1 | 7336 |
| 630 | F | I | D | D | F | T | P | Y | H | 1 | 7337 |
| 634 | F | T | P | Y | H | M | L | H | G | 1 | 7338 |
| 639 | M | L | H | G | E | V | H | C | G | 1 | 7339 |
| 644 | V | H | C | G | T | N | V | C | R | 1 | 7340 |
| 646 | C | G | T | N | V | C | R | K | P | 1 | 7341 |
| 184P1E2 v.2: HLA Peptide Scoring Results B2709 9-mers SYFPEITHI | | | | | | | | | | | |
| 3 | M | T | P | S | T | L | A | P | L | 11 | 7342 |
| 5 | P | S | T | L | A | P | L | E | V | 10 | 7343 |
| 7 | T | L | A | P | L | E | V | Y | V | 10 | 7344 |
| 2 | I | M | T | P | S | T | L | A | P | 4 | 7345 |
| 9 | A | P | L | E | V | Y | V | C | R | 4 | 7346 |
| 4 | T | P | S | T | L | A | P | L | E | 2 | 7347 |
| 6 | S | T | L | A | P | L | E | V | Y | 2 | 7348 |
| 8 | L | A | P | L | E | V | Y | V | C | 2 | 7349 |
| 184P1E2 v.3: HLA Peptide Scoring Results B2709 9-mers SYFPEITHI | | | | | | | | | | | |
| 1 | D | E | F | L | S | F | V | P | V | 11 | 7350 |
| 7 | V | P | V | P | D | G | K | G | F | 11 | 7351 |
| 9 | V | P | D | G | K | G | F | R | M | 9 | 7352 |
| 2 | E | F | L | S | F | V | P | V | P | 5 | 7353 |
| 4 | L | S | F | V | P | V | P | D | G | 4 | 7354 |
| 5 | S | F | V | P | V | P | D | G | K | 2 | 7355 |
| 3 | F | L | S | F | V | P | V | P | D | 1 | 7256 |

TABLE XXXIII

| Pos | 1 | 2 | 3 | 4 | 5 | 6 | 7 | 8 | 9 | score | SEQ. ID NO. |
|---|---|---|---|---|---|---|---|---|---|---|---|
| 184P1E2 v.1: HLA Peptide Scoring Results B4402 9-mers SYFPEITHI | | | | | | | | | | | |
| 421 | K | E | Y | P | L | G | R | I | L | 25 | 7357 |
| 340 | A | E | N | R | n | D | R | W | I | 24 | 7358 |
| 177 | L | E | D | M | S | V | M | V | L | 23 | 7359 |
| 246 | E | E | R | F | F | V | E | G | L | 23 | 7360 |
| 575 | T | E | R | K | K | A | T | A | F | 23 | 7361 |
| 60 | R | E | R | A | D | T | R | R | W | 22 | 7362 |
| 125 | C | E | G | R | Q | D | R | N | F | 22 | 7363 |
| 613 | L | E | E | K | V | R | S | L | L | 22 | 7364 |
| 276 | N | E | D | F | S | A | S | P | I | 21 | 7365 |
| 520 | D | E | Q | V | K | T | I | S | I | 20 | 7366 |
| 99 | S | H | E | P | L | P | L | A | Y | 18 | 7367 |
| 259 | A | G | F | T | G | L | I | S | F | 18 | 7368 |
| 562 | A | E | C | D | I | I | D | I | P | 18 | 7369 |
| 301 | S | T | L | P | P | L | E | V | Y | 17 | 7370 |
| 564 | C | D | I | I | D | I | P | Q | L | 17 | 7371 |
| 565 | D | I | I | D | I | P | Q | L | F | 17 | 7372 |
| 595 | K | H | L | G | I | P | K | P | F | 17 | 7373 |
| 191 | A | A | L | F | D | D | H | K | L | 16 | 7374 |
| 237 | Y | E | V | P | R | L | H | G | D | 16 | 7375 |
| 283 | P | I | F | T | D | T | V | V | F | 16 | 7376 |
| 377 | Q | D | F | P | Y | K | R | I | L | 16 | 7377 |
| 454 | K | V | Q | P | P | V | E | L | F | 16 | 7378 |
| 491 | A | S | P | G | A | C | F | K | L | 16 | 7379 |
| 524 | K | T | I | S | I | N | Q | V | L | 16 | 7380 |
| 56 | M | E | R | G | R | H | H | A | D | 15 | 7381 |
| 263 | G | L | I | S | F | H | V | T | L | 15 | 7382 |
| 295 | P | W | I | M | T | P | S | T | L | 15 | 7383 |
| 324 | A | B | L | A | R | K | A | G | C | 15 | 7384 |
| 352 | M | E | L | G | Y | V | Q | A | P | 15 | 7385 |
| 368 | F | D | S | P | R | N | G | E | L | 15 | 7386 |
| 422 | E | Y | P | L | G | R | I | L | I | 15 | 7387 |
| 426 | G | R | I | L | I | G | G | N | L | 15 | 7388 |
| 472 | D | E | F | L | S | F | V | P | A | 15 | 7389 |
| 478 | V | P | A | P | D | G | K | G | F | 15 | 7390 |
| 492 | S | P | G | A | C | F | K | L | F | 15 | 7391 |
| 506 | C | G | H | G | R | A | L | L | F | 15 | 7392 |
| 535 | K | D | L | I | N | Y | N | K | F | 15 | 7393 |
| 553 | E | V | L | K | R | E | L | G | L | 15 | 7394 |
| 614 | E | E | K | V | R | S | L | L | E | 15 | 7395 |
| 622 | E | P | L | G | L | H | C | T | F | 15 | 7396 |
| 629 | T | F | I | D | D | F | T | P | Y | 15 | 7397 |
| 11 | L | E | H | P | T | S | A | V | C | 14 | 7398 |
| 35 | E | G | T | E | M | F | E | V | Y | 14 | 7399 |
| 43 | Y | T | P | G | V | D | I | Y | | 14 | 7400 |
| 62 | R | A | D | T | R | R | W | R | F | 14 | 7401 |
| 74 | L | E | I | I | V | V | M | N | S | 14 | 7402 |
| 103 | L | P | L | A | Y | A | V | L | Y | 14 | 7403 |
| 131 | R | N | F | V | D | K | R | Q | W | 14 | 7404 |
| 166 | N | C | D | Q | H | V | H | C | L | 14 | 7405 |
| 193 | L | F | D | D | H | K | L | V | L | 14 | 7406 |
| 277 | E | D | F | S | A | S | P | I | F | 14 | 7407 |
| 360 | P | H | K | T | L | P | V | V | F | 14 | 7408 |
| 394 | R | E | P | R | D | R | S | V | S | 14 | 7409 |
| 402 | S | G | L | D | S | F | G | N | L | 14 | 7410 |
| 504 | Q | K | C | G | H | G | R | A | L | 14 | 7411 |
| 529 | N | Q | V | L | S | N | K | D | L | 14 | 7412 |
| 547 | C | I | D | W | N | R | E | V | L | 14 | 7413 |
| 583 | F | F | P | D | L | V | N | M | L | 14 | 7414 |
| 585 | P | D | L | V | N | M | L | V | L | 14 | 7415 |
| 589 | N | M | L | V | L | G | K | H | L | 14 | 7416 |
| 605 | P | I | I | N | G | C | C | C | L | 14 | 7417 |

TABLE XXXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 618 | R | S | L | L | E | P | L | G | L | 14 | 7418 |
| 621 | L | E | P | L | G | L | H | C | T | 14 | 7419 |
| 626 | L | H | C | T | F | I | D | D | F | 14 | 7420 |
| 632 | D | D | F | T | P | Y | H | M | L | 14 | 7421 |
| 651 | C | R | K | P | F | S | F | K | W | 14 | 7422 |
| 652 | R | K | P | F | S | F | K | W | W | 14 | 7423 |
| 21 | A | G | V | E | T | L | V | D | I | 13 | 7424 |
| 32 | S | V | P | E | G | T | H | M | F | 13 | 7425 |
| 68 | W | R | F | D | A | T | L | E | I | 13 | 7426 |
| 88 | N | D | S | H | V | Q | I | S | Y | 13 | 7427 |
| 97 | H | S | S | H | E | P | L | P | L | 13 | 7428 |
| 100 | H | E | P | L | P | L | A | Y | A | 13 | 7429 |
| 102 | P | L | P | L | A | Y | A | V | L | 13 | 7430 |
| 115 | V | D | I | S | L | D | C | D | L | 13 | 7431 |
| 133 | F | V | D | K | R | Q | W | V | W | 13 | 7432 |
| 185 | L | R | T | Q | G | P | A | A | L | 13 | 7433 |
| 186 | R | T | Q | G | P | A | A | L | F | 13 | 7434 |
| 198 | K | L | V | L | H | T | S | S | Y | 13 | 7435 |
| 206 | Y | D | A | K | R | A | Q | V | F | 13 | 7436 |
| 218 | G | P | E | D | V | C | E | A | Y | 13 | 7437 |
| 222 | V | C | E | A | Y | R | H | V | L | 13 | 7438 |
| 223 | C | R | A | Y | R | H | V | L | G | 13 | 7439 |
| 234 | K | V | S | Y | E | V | P | R | L | 13 | 7440 |
| 245 | D | E | E | R | F | F | V | E | G | 13 | 7441 |
| 248 | R | F | F | V | E | G | L | S | F | 13 | 7442 |
| 264 | L | I | S | F | H | V | T | L | L | 13 | 7443 |
| 346 | R | W | I | Q | D | E | M | E | L | 13 | 7444 |
| 356 | Y | V | Q | A | P | H | K | T | L | 13 | 7445 |
| 396 | P | R | D | R | S | V | S | G | L | 13 | 7446 |
| 410 | L | E | V | S | P | P | V | V | A | 13 | 7447 |
| 415 | P | V | V | A | N | G | K | E | Y | 13 | 7448 |
| 467 | A | V | G | H | V | D | E | F | L | 13 | 7449 |
| 469 | G | H | V | D | E | F | L | S | F | 13 | 7450 |
| 482 | D | G | K | G | F | R | M | L | L | 13 | 7451 |
| 505 | K | C | G | H | G | R | A | L | L | 13 | 7452 |
| 518 | V | D | D | E | Q | V | K | T | I | 13 | 7453 |
| 552 | R | E | V | L | K | R | E | L | G | 13 | 7454 |
| 557 | R | E | L | G | L | A | E | C | D | 13 | 7455 |
| 576 | E | R | K | K | A | T | A | F | F | 13 | 7456 |
| 647 | G | T | N | V | C | R | K | P | F | 13 | 7457 |
| 649 | N | V | C | R | K | P | F | S | F | 13 | 7458 |
| 3 | L | Q | R | I | V | R | V | S | L | 12 | 7459 |
| 18 | V | C | V | A | G | V | E | T | L | 12 | 7460 |
| 22 | G | V | E | T | L | V | D | I | Y | 12 | 7461 |
| 23 | V | E | T | L | V | D | I | Y | G | 12 | 7462 |
| 37 | T | E | M | F | E | V | Y | G | T | 12 | 7463 |
| 66 | R | R | W | R | F | D | A | T | L | 12 | 7464 |
| 104 | P | L | A | Y | A | V | L | Y | L | 12 | 7465 |
| 142 | G | P | S | G | Y | G | G | I | L | 12 | 7466 |
| 143 | P | S | G | Y | G | G | I | L | L | 12 | 7467 |
| 208 | A | K | R | A | Q | V | F | H | I | 12 | 7468 |
| 242 | L | H | G | D | E | E | R | F | F | 12 | 7469 |
| 251 | V | E | G | L | S | F | P | D | A | 12 | 7470 |
| 256 | F | P | D | A | G | F | T | G | L | 12 | 7471 |
| 271 | L | L | D | D | S | N | E | D | F | 12 | 7472 |
| 288 | T | V | V | F | R | V | A | P | W | 12 | 7473 |
| 289 | V | V | F | R | V | A | P | W | I | 12 | 7474 |
| 298 | M | T | P | S | T | L | P | P | L | 12 | 7475 |
| 306 | L | E | V | Y | V | C | R | V | R | 12 | 7476 |
| 311 | C | R | V | R | N | N | T | C | F | 12 | 7477 |
| 318 | C | F | V | D | A | V | A | E | L | 12 | 7478 |
| 339 | Q | A | E | N | R | N | D | R | W | 12 | 7479 |
| 348 | I | Q | D | E | M | E | L | G | Y | 12 | 7480 |
| 350 | D | E | M | E | L | G | Y | V | Q | 12 | 7481 |
| 371 | P | R | N | G | E | L | Q | D | F | 12 | 7482 |
| 373 | N | G | E | L | Q | D | F | P | Y | 12 | 7483 |
| 374 | G | E | L | Q | D | F | P | Y | K | 12 | 7484 |
| 383 | R | I | L | G | P | D | F | G | Y | 12 | 7485 |
| 441 | R | V | T | Q | V | V | R | D | F | 12 | 7486 |
| 453 | Q | K | V | Q | P | P | V | E | L | 12 | 7487 |
| 457 | P | P | V | E | L | F | V | D | W | 12 | 7488 |
| 458 | P | V | E | L | F | V | D | W | L | 12 | 7489 |
| 459 | V | E | L | F | V | D | W | L | A | 12 | 7490 |
| 466 | L | A | V | G | H | V | D | E | F | 12 | 7491 |
| 481 | P | D | G | K | G | F | R | M | L | 12 | 7492 |
| 532 | L | S | N | K | D | L | I | N | Y | 12 | 7493 |
| 542 | K | F | V | Q | S | C | I | D | W | 12 | 7494 |
| 551 | N | R | E | V | L | K | R | E | L | 12 | 7495 |
| 561 | L | A | E | C | D | I | I | D | I | 12 | 7496 |
| 579 | K | A | T | A | F | F | P | D | L | 12 | 7497 |
| 612 | C | L | E | E | K | V | R | S | L | 12 | 7498 |
| 616 | K | V | R | S | L | L | E | P | L | 12 | 7499 |
| 34 | P | E | G | T | E | M | F | E | V | 11 | 7500 |
| 40 | F | E | V | Y | G | T | P | G | V | 11 | 7501 |
| 44 | G | T | P | G | V | D | I | Y | I | 11 | 7502 |
| 79 | V | M | N | S | P | S | N | D | L | 11 | 7503 |
| 86 | D | L | N | D | S | H | V | Q | I | 11 | 7504 |
| 95 | S | Y | H | S | S | H | E | P | L | 11 | 7505 |
| 111 | Y | L | T | C | V | D | I | S | L | 11 | 7506 |
| 138 | Q | W | V | W | G | P | S | G | Y | 11 | 7507 |
| 169 | Q | H | V | H | C | L | Q | D | L | 11 | 7508 |
| 219 | P | E | D | V | C | E | A | Y | R | 11 | 7509 |
| 229 | V | L | G | Q | D | K | V | S | Y | 11 | 7510 |
| 241 | R | L | H | G | D | E | E | R | F | 11 | 7511 |
| 253 | G | L | S | F | P | D | A | G | F | 11 | 7512 |
| 257 | P | D | A | G | F | T | G | L | I | 11 | 7513 |
| 326 | L | A | R | K | A | G | C | K | L | 11 | 7514 |
| 328 | R | K | A | G | C | K | L | T | I | 11 | 7515 |
| 376 | L | Q | D | F | P | Y | K | R | I | 11 | 7516 |
| 399 | R | S | V | S | G | L | D | S | F | 11 | 7517 |
| 417 | V | A | N | G | K | E | Y | P | L | 11 | 7518 |
| 442 | V | T | Q | V | V | R | D | F | L | 11 | 7519 |
| 530 | Q | V | L | S | N | K | D | L | I | 11 | 7520 |
| 558 | E | L | G | L | A | E | C | D | I | 11 | 7521 |
| 591 | L | V | L | G | K | H | L | G | I | 11 | 7522 |
| 599 | I | P | K | P | F | G | P | I | I | 11 | 7523 |
| 42 | V | Y | G | T | P | G | V | D | I | 10 | 7524 |
| 69 | R | F | D | A | T | L | E | I | I | 10 | 7525 |
| 72 | A | T | L | E | I | I | V | V | M | 10 | 7526 |
| 109 | V | L | Y | L | T | C | V | D | I | 10 | 7527 |
| 381 | Y | K | R | I | L | G | P | D | F | 10 | 7528 |
| 411 | E | V | S | P | P | V | V | A | N | 10 | 7529 |
| 489 | L | L | A | S | P | G | A | C | F | 10 | 7530 |
| 501 | Q | E | K | Q | K | C | G | H | G | 10 | 7531 |
| 582 | A | F | F | P | D | L | V | N | M | 10 | 7532 |
| 598 | G | I | P | K | P | F | G | P | I | 10 | 7533 |
| 642 | G | E | V | H | C | G | T | N | V | 10 | 7534 |
| 101 | E | P | L | P | L | A | Y | A | V | 9 | 7535 |
| 141 | W | G | P | S | G | Y | G | G | I | 9 | 7536 |
| 192 | A | L | F | D | D | H | K | L | V | 9 | 7537 |
| 420 | G | K | E | Y | P | L | G | R | I | 9 | 7538 |
| 559 | L | G | L | A | E | C | D | I | I | 9 | 7539 |
| 623 | P | L | G | L | H | C | T | F | I | 9 | 7540 |
| 484 | K | G | F | R | M | L | L | A | S | 8 | 7541 |
| 540 | Y | N | K | F | V | Q | S | C | I | 8 | 7542 |
| 567 | I | D | I | P | Q | L | F | K | T | 8 | 7543 |
| 601 | K | P | F | G | P | I | I | N | G | 8 | 7544 |
| 602 | P | F | G | P | I | I | N | G | C | 8 | 7545 |
| 144 | S | G | Y | G | G | I | L | L | V | 7 | 7546 |
| 280 | S | A | S | P | I | F | T | D | T | 7 | 7547 |
| 292 | R | V | A | P | W | I | M | T | P | 7 | 7548 |
| 423 | Y | P | L | G | R | I | L | I | G | 7 | 7549 |
| 460 | E | L | F | V | D | W | L | A | V | 7 | 7550 |
| 597 | L | G | I | P | K | P | F | G | P | 7 | 7551 |
| 1 | M | S | L | Q | R | I | V | R | V | 6 | 7552 |
| 2 | S | L | Q | R | I | V | R | V | S | 6 | 7553 |
| 4 | Q | R | I | V | R | V | S | L | E | 6 | 7554 |
| 12 | E | H | P | T | S | A | V | C | V | 6 | 7555 |
| 24 | E | T | L | V | D | I | Y | G | S | 6 | 7556 |
| 63 | A | D | T | R | R | W | R | F | D | 6 | 7557 |
| 71 | D | A | T | L | E | I | I | V | V | 6 | 7558 |
| 75 | E | I | I | V | V | M | N | S | P | 6 | 7559 |
| 108 | A | V | L | Y | L | T | C | V | D | 6 | 7560 |
| 147 | G | G | I | L | L | V | N | C | D | 6 | 7561 |
| 211 | A | Q | V | F | H | I | C | G | P | 6 | 7562 |
| 252 | E | G | L | S | F | P | D | A | G | 6 | 7563 |
| 254 | L | S | F | P | D | A | G | F | T | 6 | 7564 |
| 281 | A | S | P | I | F | T | D | T | V | 6 | 7565 |
| 317 | T | C | F | V | D | A | V | A | E | 6 | 7566 |
| 322 | A | V | A | E | L | A | R | K | A | 6 | 7567 |
| 323 | V | A | E | L | A | R | K | A | G | 6 | 7568 |
| 327 | A | R | K | A | G | C | K | L | T | 6 | 7569 |

TABLE XXXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 362 | K | T | L | P | V | V | F | D | S | 6 | 7570 |
| 382 | K | R | I | L | G | P | D | F | G | 6 | 7571 |
| 405 | D | S | F | G | N | L | E | V | S | 6 | 7572 |
| 436 | G | S | S | G | R | R | V | T | Q | 6 | 7573 |
| 473 | E | F | L | S | F | V | P | A | P | 6 | 7574 |
| 495 | A | C | F | K | L | F | Q | E | K | 6 | 7575 |
| 511 | A | L | L | F | Q | G | V | V | D | 6 | 7576 |
| 526 | I | S | I | N | Q | V | L | S | N | 6 | 7577 |
| 533 | S | N | K | D | L | I | N | Y | N | 6 | 7578 |
| 536 | D | L | I | N | Y | N | K | F | V | 6 | 7579 |
| 546 | S | C | I | D | W | N | R | E | V | 6 | 7580 |
| 38 | E | M | F | E | V | Y | G | T | P | 5 | 7581 |
| 41 | E | V | Y | G | T | P | G | V | D | 5 | 7582 |
| 51 | Y | I | S | P | N | M | E | R | G | 5 | 7583 |
| 61 | E | R | A | D | T | R | R | W | R | 5 | 7584 |
| 80 | M | N | S | P | S | N | D | L | N | 5 | 7585 |
| 82 | S | P | S | N | D | L | N | D | S | 5 | 7586 |
| 85 | N | D | L | N | D | S | H | V | Q | 5 | 7587 |
| 106 | A | Y | A | V | L | Y | L | T | C | 5 | 7588 |
| 128 | R | Q | D | R | N | F | V | D | K | 5 | 7589 |
| 145 | G | Y | G | G | I | L | L | V | N | 5 | 7590 |
| 156 | R | D | D | P | S | C | D | V | Q | 5 | 7591 |
| 178 | E | D | M | S | V | M | V | L | R | 5 | 7592 |
| 187 | T | Q | G | P | A | A | L | F | D | 5 | 7593 |
| 204 | S | S | Y | D | A | K | R | A | Q | 5 | 7594 |
| 224 | E | A | Y | R | H | V | L | G | Q | 5 | 7595 |
| 225 | A | Y | R | H | V | L | G | Q | D | 5 | 7596 |
| 228 | H | V | L | G | Q | D | K | V | S | 5 | 7597 |
| 247 | E | R | F | F | V | E | G | L | S | 5 | 7598 |
| 265 | I | S | F | H | V | T | L | L | D | 5 | 7599 |
| 282 | S | P | I | F | T | D | T | V | V | 5 | 7600 |
| 297 | I | M | T | P | S | T | L | P | P | 5 | 7601 |
| 302 | T | L | P | P | L | E | V | Y | V | 5 | 7602 |
| 330 | A | G | C | K | L | T | I | C | P | 5 | 7603 |
| 342 | N | R | N | D | R | W | I | Q | D | 5 | 7604 |
| 343 | R | N | D | R | W | I | Q | D | E | 5 | 7605 |
| 351 | E | M | E | L | G | Y | V | Q | A | 5 | 7606 |
| 359 | A | P | H | K | T | L | P | V | V | 5 | 7607 |
| 366 | V | V | F | D | S | P | R | N | G | 5 | 7608 |
| 375 | E | L | Q | D | F | P | Y | K | R | 5 | 7609 |
| 379 | F | P | Y | K | R | I | L | G | P | 5 | 7610 |
| 393 | T | R | E | P | R | D | R | S | V | 5 | 7611 |
| 395 | E | P | R | D | R | S | V | S | G | 5 | 7612 |
| 412 | V | S | P | P | V | V | A | N | G | 5 | 7613 |
| 428 | I | L | I | G | G | N | L | P | G | 5 | 7614 |
| 437 | S | S | G | R | R | V | T | Q | V | 5 | 7615 |
| 445 | V | V | R | D | F | L | H | A | Q | 5 | 7616 |
| 447 | R | D | F | L | H | A | Q | K | V | 5 | 7617 |
| 452 | A | Q | K | V | Q | P | P | V | E | 5 | 7618 |
| 455 | V | Q | P | P | V | E | L | F | V | 5 | 7619 |
| 476 | S | F | V | P | A | P | D | G | K | 5 | 7620 |
| 480 | A | P | D | G | K | G | F | R | M | 5 | 7621 |
| 490 | L | A | S | P | G | A | C | F | K | 5 | 7622 |
| 521 | E | Q | V | K | T | I | S | I | N | 5 | 7623 |
| 523 | V | K | T | I | S | I | N | Q | V | 5 | 7624 |
| 563 | E | C | D | I | I | D | I | P | Q | 5 | 7625 |
| 568 | D | I | P | Q | L | F | K | T | E | 5 | 7626 |
| 572 | L | F | K | T | E | R | K | K | A | 5 | 7627 |
| 573 | F | K | T | E | R | K | A | T | 5 | 7628 |
| 580 | A | T | A | F | F | P | D | L | V | 5 | 7629 |
| 594 | G | K | H | L | G | I | P | K | P | 5 | 7630 |
| 615 | E | K | V | R | S | L | L | E | P | 5 | 7631 |
| 643 | E | V | H | C | G | T | N | V | C | 5 | 7632 |
| 10 | S | L | E | H | P | T | S | A | V | 4 | 7633 |
| 14 | P | T | S | A | V | C | V | A | G | 4 | 7634 |
| 17 | A | V | C | V | A | G | V | E | T | 4 | 7635 |
| 27 | V | D | I | Y | G | S | V | P | E | 4 | 7636 |
| 47 | G | V | D | I | Y | I | S | P | N | 4 | 7637 |
| 48 | V | D | I | Y | I | S | P | N | M | 4 | 7638 |
| 57 | E | R | G | R | E | R | A | D | T | 4 | 7639 |
| 65 | T | R | R | W | R | F | D | A | T | 4 | 7640 |
| 81 | N | S | P | S | N | D | L | N | D | 4 | 7641 |
| 84 | S | N | D | L | N | D | S | H | V | 4 | 7642 |
| 112 | L | T | C | V | D | I | S | L | D | 4 | 7643 |
| 118 | S | L | D | C | D | L | N | C | E | 4 | 7644 |
| 126 | E | G | R | Q | D | R | N | F | V | 4 | 7645 |
| 181 | S | V | M | V | L | R | T | Q | G | 4 | 7646 |
| 194 | F | D | D | H | K | L | V | L | H | 4 | 7647 |
| 196 | D | H | K | L | V | L | H | T | S | 4 | 7648 |
| 203 | T | S | S | Y | D | A | K | R | A | 4 | 7649 |
| 205 | S | Y | D | A | K | R | A | Q | V | 4 | 7650 |
| 214 | F | H | I | C | G | P | E | D | V | 4 | 7651 |
| 216 | I | C | G | P | E | D | V | C | E | 4 | 7652 |
| 238 | E | V | P | R | L | H | G | D | E | 4 | 7653 |
| 255 | S | F | P | D | A | G | F | T | G | 4 | 7654 |
| 260 | G | F | T | G | L | I | S | F | H | 4 | 7655 |
| 262 | T | G | L | I | S | F | H | V | T | 4 | 7656 |
| 279 | F | S | A | S | P | I | P | T | D | 4 | 7657 |
| 287 | D | T | V | V | F | R | V | A | P | 4 | 7658 |
| 294 | A | P | W | I | M | T | P | S | T | 4 | 7659 |
| 299 | T | P | S | T | L | P | P | L | E | 4 | 7660 |
| 303 | L | P | P | L | E | V | Y | V | C | 4 | 7661 |
| 307 | E | V | Y | Y | C | R | V | R | N | 4 | 7662 |
| 315 | N | N | T | C | F | V | D | A | V | 4 | 7663 |
| 325 | E | L | A | R | K | A | G | C | K | 4 | 7664 |
| 331 | G | C | K | L | T | I | C | P | Q | 4 | 7665 |
| 332 | C | K | L | T | I | C | P | Q | A | 4 | 7666 |
| 333 | K | L | T | I | C | P | Q | A | E | 4 | 7667 |
| 335 | T | I | C | P | Q | A | E | N | R | 4 | 7668 |
| 341 | E | N | R | N | D | R | W | I | Q | 4 | 7669 |
| 357 | V | Q | A | P | H | K | T | L | P | 4 | 7670 |
| 369 | D | S | P | R | N | G | E | L | Q | 4 | 7671 |
| 370 | S | P | R | N | G | E | L | Q | D | 4 | 7672 |
| 378 | D | F | P | Y | K | R | I | L | G | 4 | 7673 |
| 384 | I | L | G | P | D | F | G | Y | V | 4 | 7674 |
| 387 | P | D | F | G | Y | V | T | R | E | 4 | 7675 |
| 413 | S | P | P | V | V | A | N | G | K | 4 | 7676 |
| 418 | A | N | G | K | E | Y | P | L | G | 4 | 7677 |
| 424 | P | L | G | R | I | L | I | G | G | 4 | 7678 |
| 432 | G | N | L | P | G | S | S | G | R | 4 | 7679 |
| 435 | P | G | S | S | G | R | R | V | T | 4 | 7680 |
| 438 | S | G | R | R | V | T | Q | V | V | 4 | 7681 |
| 448 | D | F | L | H | A | Q | K | V | Q | 4 | 7682 |
| 488 | M | L | L | A | S | P | G | A | C | 4 | 7683 |
| 497 | F | K | L | F | Q | E | K | Q | K | 4 | 7684 |
| 498 | K | L | F | Q | E | K | Q | K | C | 4 | 7685 |
| 512 | L | L | F | Q | G | V | V | D | D | 4 | 7686 |
| 517 | V | V | D | D | Q | V | K | T | 4 | 7687 |
| 525 | T | I | S | I | N | Q | V | L | S | 4 | 7688 |
| 534 | N | K | D | L | I | N | Y | N | K | 4 | 7689 |
| 538 | I | N | Y | N | K | F | V | Q | S | 4 | 7690 |
| 548 | I | D | W | N | R | E | V | L | K | 4 | 7691 |
| 549 | D | W | N | R | E | V | L | K | R | 4 | 7692 |
| 571 | Q | L | F | K | T | E | R | K | K | 4 | 7693 |
| 581 | T | A | F | F | P | D | L | V | N | 4 | 7694 |
| 586 | D | L | V | N | M | L | V | L | G | 4 | 7695 |
| 588 | V | N | M | L | V | L | G | K | H | 4 | 7696 |
| 604 | G | P | I | I | N | G | C | C | C | 4 | 7697 |
| 610 | C | C | C | L | E | E | K | V | R | 4 | 7698 |
| 619 | S | L | L | E | P | L | G | L | H | 4 | 7699 |
| 620 | L | L | E | P | L | G | L | H | C | 4 | 7700 |
| 633 | D | F | T | P | Y | H | M | L | H | 4 | 7701 |
| 8 | R | V | S | L | E | H | P | T | S | 3 | 7702 |
| 16 | S | A | V | C | V | A | G | V | E | 3 | 7703 |
| 20 | V | A | G | V | E | T | L | V | D | 3 | 7704 |
| 31 | G | S | V | P | E | G | T | E | M | 3 | 7705 |
| 45 | T | P | G | V | D | I | Y | I | S | 3 | 7706 |
| 46 | P | G | V | D | I | Y | I | S | P | 3 | 7707 |
| 50 | I | Y | I | S | P | N | M | E | R | 3 | 7708 |
| 52 | I | S | P | N | M | E | R | G | R | 3 | 7709 |
| 54 | P | N | M | E | R | G | R | E | R | 3 | 7710 |
| 55 | N | M | E | R | G | R | E | R | A | 3 | 7711 |
| 58 | R | G | R | E | R | A | D | T | R | 3 | 7712 |
| 73 | T | L | E | I | I | V | V | M | N | 3 | 7713 |
| 78 | V | V | M | N | S | P | S | N | D | 3 | 7714 |
| 89 | D | S | H | V | Q | I | S | Y | H | 3 | 7715 |
| 92 | V | Q | I | S | Y | H | S | S | H | 3 | 7716 |
| 98 | S | S | H | E | P | L | P | L | A | 3 | 7717 |
| 110 | L | Y | L | T | C | V | D | I | S | 3 | 7718 |
| 113 | T | C | V | D | I | S | L | D | C | 3 | 7719 |
| 116 | D | I | S | L | D | C | D | L | N | 3 | 7720 |
| 117 | I | S | L | D | C | D | L | N | C | 3 | 7721 |

TABLE XXXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 120 | D | C | D | L | N | C | E | G | R | 3 | 7722 |
| 124 | M | C | E | G | R | Q | D | R | N | 3 | 7723 |
| 127 | G | R | Q | D | R | N | F | V | D | 3 | 7724 |
| 129 | Q | D | R | N | F | V | D | K | R | 3 | 7725 |
| 132 | N | F | V | D | K | R | Q | W | V | 3 | 7726 |
| 140 | V | W | G | P | S | G | Y | G | G | 3 | 7727 |
| 153 | N | C | D | R | D | D | P | S | C | 3 | 7728 |
| 157 | D | D | P | S | C | D | V | Q | D | 3 | 7729 |
| 160 | S | C | D | V | Q | D | N | C | D | 3 | 7730 |
| 162 | D | V | Q | D | N | C | D | Q | H | 3 | 7731 |
| 179 | D | M | S | V | M | V | L | R | T | 3 | 7732 |
| 180 | M | S | V | M | V | L | R | T | Q | 3 | 7733 |
| 182 | V | M | V | L | R | T | Q | G | P | 3 | 7734 |
| 184 | V | L | R | T | Q | G | P | A | A | 3 | 7735 |
| 209 | K | R | A | Q | V | F | H | I | C | 3 | 7736 |
| 212 | Q | V | F | H | I | C | G | P | E | 3 | 7737 |
| 220 | E | D | V | C | E | A | Y | R | H | 3 | 7738 |
| 235 | V | S | Y | E | V | P | R | L | H | 3 | 7739 |
| 236 | S | Y | E | V | P | R | L | H | G | 3 | 7740 |
| 244 | G | D | E | E | R | F | F | V | E | 3 | 7741 |
| 266 | S | F | H | V | T | L | L | D | D | 3 | 7742 |
| 270 | T | L | L | D | D | S | N | E | D | 3 | 7743 |
| 274 | D | S | N | E | D | F | S | A | S | 3 | 7744 |
| 278 | D | F | S | A | S | P | I | F | T | 3 | 7745 |
| 284 | I | F | T | D | T | V | V | F | R | 3 | 7746 |
| 285 | P | T | D | T | V | V | F | R | V | 3 | 7747 |
| 286 | T | D | T | V | V | F | R | V | A | 3 | 7748 |
| 296 | W | I | M | T | P | S | T | L | P | 3 | 7749 |
| 300 | P | S | T | L | P | P | L | E | V | 3 | 7750 |
| 308 | V | Y | V | C | R | V | R | N | N | 3 | 7751 |
| 309 | Y | V | C | R | V | R | N | N | T | 3 | 7752 |
| 310 | V | C | R | V | R | N | N | T | C | 3 | 7753 |
| 312 | R | V | R | N | N | T | C | F | V | 3 | 7754 |
| 314 | R | N | N | T | C | F | V | D | A | 3 | 7755 |
| 319 | P | V | D | A | V | A | E | L | A | 3 | 7756 |
| 320 | V | D | A | V | A | E | L | A | R | 3 | 7757 |
| 334 | L | T | I | C | P | Q | A | E | N | 3 | 7758 |
| 338 | P | Q | A | E | N | R | M | D | R | 3 | 7759 |
| 355 | G | Y | V | Q | A | P | H | K | T | 3 | 7760 |
| 358 | Q | A | P | H | K | T | L | P | V | 3 | 7761 |
| 361 | H | K | T | L | P | V | V | F | D | 3 | 7762 |
| 367 | V | F | D | S | P | R | N | G | E | 3 | 7763 |
| 380 | P | Y | K | R | I | L | G | P | D | 3 | 7764 |
| 385 | L | Q | P | D | F | G | Y | V | T | 3 | 7765 |
| 386 | G | P | D | F | G | Y | V | T | R | 3 | 7766 |
| 391 | Y | V | T | R | E | P | R | D | R | 3 | 7767 |
| 400 | S | V | S | G | L | D | S | F | G | 3 | 7768 |
| 403 | G | L | D | S | F | G | N | L | E | 3 | 7769 |
| 406 | S | F | G | N | L | E | V | S | P | 3 | 7770 |
| 409 | N | L | E | V | S | P | P | V | V | 3 | 7771 |
| 419 | N | G | K | E | Y | P | L | G | R | 3 | 7772 |
| 425 | L | G | R | I | L | I | G | G | N | 3 | 7773 |
| 427 | R | I | L | I | G | G | N | L | P | 3 | 7774 |
| 429 | L | I | G | G | N | L | P | G | S | 3 | 7775 |
| 433 | N | L | P | G | S | S | G | R | R | 3 | 7776 |
| 440 | R | V | T | Q | V | V | R | D | D | 3 | 7777 |
| 444 | Q | V | V | R | D | F | L | H | A | 3 | 7778 |
| 456 | Q | P | P | V | E | L | F | V | D | 3 | 7779 |
| 461 | L | F | V | D | W | L | A | V | G | 3 | 7780 |
| 462 | F | V | D | W | L | A | V | G | H | 3 | 7781 |
| 464 | D | W | L | A | V | G | H | V | D | 3 | 7782 |
| 475 | L | S | F | V | P | A | P | D | G | 3 | 7783 |
| 483 | G | K | G | F | R | M | L | L | A | 3 | 7784 |
| 486 | F | R | M | L | L | A | S | P | G | 3 | 7785 |
| 502 | E | K | Q | K | C | G | H | G | R | 3 | 7786 |
| 507 | G | H | G | R | A | L | L | F | Q | 3 | 7787 |
| 510 | R | A | L | L | F | Q | G | V | V | 3 | 7788 |
| 522 | Q | V | K | T | I | S | I | N | Q | 3 | 7789 |
| 531 | V | L | S | N | K | D | L | I | N | 3 | 7790 |
| 541 | N | K | F | V | Q | S | C | I | D | 3 | 7791 |
| 543 | F | V | Q | S | C | I | D | W | N | 3 | 7792 |
| 550 | W | N | R | E | L | V | K | W | E | 3 | 7793 |
| 554 | V | L | K | R | E | L | G | L | A | 3 | 7794 |
| 555 | L | K | R | E | L | G | L | A | E | 3 | 7795 |
| 556 | K | R | E | L | G | L | A | E | C | 3 | 7796 |
| 574 | K | T | E | R | K | K | A | T | A | 3 | 7797 |
| 578 | K | K | A | T | A | F | F | P | D | 3 | 7798 |
| 584 | F | P | D | L | V | M | M | L | V | 3 | 7799 |
| 590 | M | L | V | L | G | K | H | L | G | 3 | 7800 |
| 600 | P | K | P | F | G | P | I | I | N | 3 | 7801 |
| 617 | V | R | S | L | L | E | P | L | G | 3 | 7802 |
| 628 | C | T | F | I | D | D | F | T | P | 3 | 7803 |
| 630 | F | I | D | D | F | T | P | Y | H | 3 | 7804 |
| 637 | Y | H | M | L | H | G | E | V | H | 3 | 7805 |
| 639 | M | L | H | G | E | V | H | C | G | 3 | 7806 |
| 645 | H | C | G | T | N | V | C | R | K | 3 | 7807 |
| 646 | C | G | T | N | V | C | R | K | P | 3 | 7808 |
| 653 | K | P | F | S | F | K | W | W | N | 3 | 7809 |
| 655 | F | S | F | K | W | W | N | M | V | 3 | 7810 |
| 5 | R | I | V | R | V | S | L | E | H | 2 | 7811 |
| 9 | V | S | L | E | H | P | T | S | A | 2 | 7812 |
| 13 | H | P | T | S | A | V | C | V | A | 2 | 7813 |
| 19 | C | V | A | G | V | E | T | L | V | 2 | 7814 |
| 25 | T | L | V | D | I | Y | G | S | V | 2 | 7815 |
| 26 | L | V | D | I | Y | G | S | V | P | 2 | 7816 |
| 28 | D | I | Y | G | S | V | P | E | G | 2 | 7817 |
| 30 | Y | G | S | V | P | E | G | T | E | 2 | 7818 |
| 49 | D | I | Y | I | S | P | N | M | E | 2 | 7819 |
| 53 | S | P | N | M | E | R | G | R | E | 2 | 7820 |
| 64 | D | T | R | R | W | R | F | D | A | 2 | 7821 |
| 67 | R | W | R | F | D | A | T | L | E | 2 | 7822 |
| 70 | F | D | A | T | L | E | I | I | V | 2 | 7823 |
| 87 | L | N | D | S | H | V | Q | I | S | 2 | 7824 |
| 90 | S | H | V | Q | I | S | Y | H | S | 2 | 7825 |
| 96 | Y | H | S | S | H | E | P | L | P | 2 | 7826 |
| 105 | L | A | Y | A | V | L | Y | L | T | 2 | 7827 |
| 107 | Y | A | V | L | Y | L | T | C | V | 2 | 7828 |
| 114 | C | V | D | I | S | L | D | C | D | 2 | 7829 |
| 121 | C | D | L | N | C | E | G | R | Q | 2 | 7830 |
| 122 | D | L | N | C | E | G | R | Q | D | 2 | 7831 |
| 130 | D | R | N | F | V | D | K | R | Q | 2 | 7832 |
| 134 | V | D | K | R | Q | W | V | W | G | 2 | 7833 |
| 146 | Y | G | G | I | L | L | V | N | C | 2 | 7834 |
| 148 | G | I | L | L | V | N | C | D | R | 2 | 7835 |
| 149 | I | L | L | V | N | C | D | R | D | 2 | 7836 |
| 150 | L | L | V | N | C | D | R | D | D | 2 | 7837 |
| 152 | V | N | C | D | R | D | D | P | S | 2 | 7838 |
| 154 | C | D | R | D | D | P | S | C | D | 2 | 7839 |
| 155 | D | R | D | D | P | S | C | D | V | 2 | 7840 |
| 158 | D | P | S | C | D | V | Q | D | N | 2 | 7841 |
| 163 | V | Q | D | N | C | D | Q | H | V | 2 | 7842 |
| 164 | Q | D | N | C | D | Q | H | V | H | 2 | 7843 |
| 165 | D | N | C | D | Q | H | V | H | C | 2 | 7844 |
| 168 | D | Q | H | V | H | C | L | Q | D | 2 | 7845 |
| 171 | V | H | C | L | Q | D | L | E | D | 2 | 7846 |
| 172 | H | C | L | Q | D | L | E | D | M | 2 | 7847 |
| 174 | L | Q | D | L | E | D | M | S | V | 2 | 7848 |
| 175 | Q | D | L | E | D | M | S | V | M | 2 | 7849 |
| 176 | D | L | E | D | M | S | V | M | V | 2 | 7850 |
| 183 | M | V | L | R | T | Q | G | P | A | 2 | 7851 |
| 188 | Q | G | P | A | A | L | F | D | D | 2 | 7852 |
| 195 | D | D | H | K | L | V | L | H | T | 2 | 7853 |
| 201 | L | H | T | S | S | Y | D | A | K | 2 | 7854 |
| 202 | H | T | S | S | Y | D | A | K | R | 2 | 7855 |
| 207 | D | A | K | R | A | Q | V | F | H | 2 | 7856 |
| 215 | H | I | C | G | P | E | D | V | C | 2 | 7857 |
| 217 | C | G | P | E | D | V | C | E | A | 2 | 7858 |
| 227 | R | H | V | L | G | Q | D | K | V | 2 | 7859 |
| 230 | L | G | Q | D | K | V | S | Y | E | 2 | 7860 |
| 243 | H | G | D | E | E | R | F | F | V | 2 | 7861 |
| 261 | F | T | G | L | I | S | F | H | V | 2 | 7862 |
| 267 | F | H | V | T | L | L | D | D | S | 2 | 7863 |
| 269 | V | T | L | L | D | D | S | N | N | 2 | 7864 |
| 272 | L | D | D | S | N | E | D | F | S | 2 | 7865 |
| 273 | D | D | S | N | E | D | F | S | A | 2 | 7866 |
| 275 | S | N | E | D | F | S | A | S | P | 2 | 7867 |
| 293 | V | A | P | W | I | M | T | P | S | 2 | 7868 |
| 304 | P | P | L | E | V | Y | V | C | R | 2 | 7869 |
| 313 | V | R | N | N | T | C | F | V | D | 2 | 7870 |
| 316 | N | T | C | F | V | D | A | V | A | 2 | 7871 |
| 329 | K | A | G | C | K | L | T | I | C | 2 | 7872 |
| 336 | I | C | P | Q | A | E | N | R | N | 2 | 7873 |

TABLE XXXIII-continued

| Pos | 1 | 2 | 3 | 4 | 5 | 6 | 7 | 8 | 9 | score | SEQ. ID NO. |
|---|---|---|---|---|---|---|---|---|---|---|---|
| 344 | N | D | R | W | I | Q | D | E | M | 2 | 7874 |
| 347 | W | I | Q | D | E | M | E | L | G | 2 | 7875 |
| 353 | E | L | G | Y | V | Q | A | P | H | 2 | 7876 |
| 363 | T | L | P | V | V | F | D | S | P | 2 | 7877 |
| 388 | D | F | G | Y | V | T | R | E | P | 2 | 7878 |
| 390 | G | Y | V | T | R | E | P | R | D | 2 | 7879 |
| 398 | D | R | S | V | S | G | L | D | S | 2 | 7880 |
| 404 | L | D | S | F | G | N | L | E | V | 2 | 7881 |
| 407 | F | G | N | L | E | V | S | P | P | 2 | 7882 |
| 430 | I | G | G | N | L | P | G | S | S | 2 | 7883 |
| 439 | G | R | R | V | T | Q | V | V | R | 2 | 7884 |
| 443 | T | Q | V | V | R | D | F | L | H | 2 | 7885 |
| 446 | V | R | D | F | L | H | A | Q | K | 2 | 7886 |
| 449 | F | L | H | A | Q | K | V | Q | P | 2 | 7887 |
| 463 | V | D | W | L | A | V | G | H | V | 2 | 7888 |
| 470 | H | V | D | E | F | L | S | F | V | 2 | 7889 |
| 474 | F | L | S | F | V | P | A | P | D | 2 | 7890 |
| 477 | F | V | P | A | P | D | G | K | G | 2 | 7891 |
| 479 | P | A | P | D | G | K | G | F | R | 2 | 7892 |
| 487 | R | M | L | L | A | S | P | G | A | 2 | 7893 |
| 494 | G | A | C | F | K | L | F | Q | E | 2 | 7894 |
| 496 | C | F | K | L | F | Q | E | K | Q | 2 | 7895 |
| 499 | L | F | Q | E | K | Q | K | C | G | 2 | 7896 |
| 508 | H | G | R | A | L | L | F | Q | G | 2 | 7897 |
| 509 | G | R | A | L | L | F | Q | G | V | 2 | 7898 |
| 513 | L | F | Q | G | V | V | D | D | E | 2 | 7899 |
| 516 | G | V | V | D | D | E | Q | V | K | 2 | 7900 |
| 527 | S | I | N | Q | V | L | S | N | K | 2 | 7901 |
| 528 | I | N | Q | V | L | S | N | K | D | 2 | 7902 |
| 537 | L | I | N | Y | N | K | F | V | Q | 2 | 7903 |
| 539 | N | Y | N | K | F | V | Q | S | C | 2 | 7904 |
| 544 | V | Q | S | C | I | D | W | N | R | 2 | 7905 |
| 566 | I | I | D | I | P | Q | L | F | K | 2 | 7906 |
| 570 | P | Q | L | F | K | T | E | R | K | 2 | 7907 |
| 587 | L | V | N | M | L | V | L | G | K | 2 | 7908 |
| 603 | F | G | P | I | I | N | G | C | C | 2 | 7909 |
| 606 | I | I | N | G | C | C | C | L | N | 2 | 7910 |
| 608 | N | G | C | C | C | L | E | E | K | 2 | 7911 |
| 611 | C | C | L | E | E | K | V | R | S | 2 | 7912 |
| 624 | L | G | L | H | C | T | F | I | D | 2 | 7913 |
| 625 | G | L | H | C | T | F | I | D | D | 2 | 7914 |
| 631 | I | D | D | F | T | P | Y | H | M | 2 | 7915 |
| 634 | F | T | P | Y | H | M | L | H | G | 2 | 7916 |
| 635 | T | P | Y | H | M | L | H | G | E | 2 | 7917 |
| 638 | H | M | L | H | G | E | V | H | C | 2 | 7918 |
| 644 | V | H | C | G | T | N | V | C | R | 2 | 7919 |
| 656 | S | F | K | W | W | N | M | V | P | 2 | 7920 |
| 6 | I | V | R | V | S | L | E | H | P | 1 | 7921 |
| 7 | V | R | V | S | L | E | H | P | T | 1 | 7922 |
| 15 | T | S | A | V | C | V | A | G | V | 1 | 7923 |
| 29 | I | Y | G | S | V | P | E | G | T | 1 | 7924 |
| 33 | V | P | E | G | T | E | M | F | E | 1 | 7925 |
| 36 | G | T | E | M | F | E | V | Y | G | 1 | 7926 |
| 59 | G | R | E | R | A | D | T | R | R | 1 | 7927 |
| 77 | I | V | V | M | N | S | P | S | N | 1 | 7928 |
| 83 | P | S | N | D | L | N | D | S | H | 1 | 7929 |
| 91 | H | V | Q | I | S | Y | H | S | S | 1 | 7930 |
| 93 | Q | I | S | Y | H | S | S | H | E | 1 | 7931 |
| 94 | I | S | Y | H | S | S | H | E | P | 1 | 7932 |
| 119 | L | D | C | C | D | L | N | C | E | G | 1 | 7933 |
| 123 | L | N | C | E | G | R | Q | D | R | 1 | 7934 |
| 135 | D | K | R | Q | W | V | W | G | P | 1 | 7935 |
| 136 | K | R | Q | W | V | W | G | P | S | 1 | 7936 |
| 139 | W | V | W | G | P | S | G | Y | G | 1 | 7937 |
| 151 | L | V | N | C | D | H | D | D | P | 1 | 7938 |
| 159 | P | S | C | D | V | Q | D | N | C | 1 | 7939 |
| 167 | C | D | Q | H | V | H | C | L | Q | 1 | 7940 |
| 170 | H | V | H | C | L | Q | D | L | E | 1 | 7941 |
| 173 | C | L | Q | D | L | E | D | M | S | 1 | 7942 |
| 189 | G | P | A | A | L | F | D | D | H | 1 | 7943 |
| 190 | P | A | A | L | F | D | D | H | K | 1 | 7944 |
| 197 | H | K | L | V | L | H | T | S | S | 1 | 7945 |
| 199 | L | V | L | H | T | S | S | Y | D | 1 | 7946 |
| 200 | V | L | H | T | S | S | Y | D | A | 1 | 7947 |
| 210 | R | A | Q | V | F | H | I | C | G | 1 | 7948 |
| 221 | D | V | C | E | A | Y | R | H | V | 1 | 7949 |
| 231 | G | Q | D | K | V | S | Y | E | V | 1 | 7950 |
| 232 | Q | D | K | V | S | Y | H | V | P | 1 | 7951 |
| 233 | D | K | V | S | Y | H | V | P | R | 1 | 7952 |
| 239 | V | P | R | L | H | G | D | E | E | 1 | 7953 |
| 240 | P | R | L | H | G | D | E | E | R | 1 | 7954 |
| 249 | F | F | V | E | G | L | S | F | P | 1 | 7955 |
| 250 | F | V | E | G | L | S | F | P | D | 1 | 7956 |
| 258 | D | A | G | F | T | G | L | I | S | 1 | 7957 |
| 268 | H | V | T | L | L | D | D | S | N | 1 | 7958 |
| 290 | V | F | R | V | A | P | W | I | M | 1 | 7959 |
| 291 | F | R | V | A | P | W | I | M | T | 1 | 7960 |
| 305 | P | L | E | V | Y | V | C | R | V | 1 | 7961 |
| 321 | D | A | V | A | E | L | A | R | K | 1 | 7962 |
| 337 | C | P | Q | A | E | N | R | N | D | 1 | 7963 |
| 349 | Q | D | E | M | E | L | G | Y | V | 1 | 7964 |
| 354 | L | G | Y | V | Q | A | P | H | K | 1 | 7965 |
| 389 | F | G | Y | V | T | R | E | P | R | 1 | 7966 |
| 392 | V | T | R | E | P | R | D | R | S | 1 | 7967 |
| 397 | R | D | R | S | V | S | G | L | D | 1 | 7968 |
| 401 | V | S | G | L | D | S | F | G | N | 1 | 7969 |
| 408 | G | N | L | E | V | S | P | P | V | 1 | 7970 |
| 414 | P | P | V | V | A | N | G | K | E | 1 | 7971 |
| 416 | V | V | A | N | G | K | E | Y | P | 1 | 7972 |
| 431 | G | G | N | L | P | G | S | S | G | 1 | 7973 |
| 434 | L | P | G | S | S | G | R | R | V | 1 | 7974 |
| 450 | L | H | A | Q | K | V | Q | P | P | 1 | 7975 |
| 465 | W | L | A | V | G | H | V | D | E | 1 | 7976 |
| 468 | V | G | H | V | D | H | F | L | S | 1 | 7977 |
| 471 | V | D | H | F | L | S | F | V | P | 1 | 7978 |
| 485 | G | F | R | M | L | L | A | S | P | 1 | 7979 |
| 493 | P | G | A | C | F | K | L | F | Q | 1 | 7980 |
| 503 | K | Q | K | C | G | H | G | R | A | 1 | 7981 |
| 515 | Q | G | V | V | D | D | E | Q | V | 1 | 7982 |
| 545 | Q | S | C | I | D | W | N | R | E | 1 | 7983 |
| 560 | G | L | A | E | C | D | I | I | D | 1 | 7984 |
| 569 | I | P | Q | L | F | K | T | E | R | 1 | 7985 |
| 577 | R | K | K | A | T | A | F | F | P | 1 | 7986 |
| 592 | V | L | G | K | H | L | G | I | P | 1 | 7987 |
| 593 | L | G | K | H | L | G | I | P | K | 1 | 7988 |
| 607 | I | N | G | C | C | C | L | E | E | 1 | 7989 |
| 609 | G | C | C | C | L | E | E | K | V | 1 | 7990 |
| 627 | H | C | T | F | I | D | D | F | T | 1 | 7991 |
| 641 | H | G | E | V | H | C | G | T | N | 1 | 7992 |
| 648 | T | N | V | C | R | K | P | F | S | 1 | 7993 |
| 650 | V | C | R | K | P | F | S | F | K | 1 | 7994 |
| 654 | P | F | S | F | K | W | W | N | M | 1 | 7995 |

184P1E2 v.2: HLA Peptide Scoring
Results B4402 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 6 | S | T | L | A | P | L | E | V | Y | 14 | 7996 |
| 3 | M | T | P | S | T | L | A | P | L | 12 | 7997 |
| 2 | I | M | T | P | S | T | L | A | P | 7 | 7998 |
| 9 | A | P | L | E | V | Y | V | C | R | 5 | 7999 |
| 4 | T | P | S | T | L | A | P | L | E | 4 | 8000 |
| 7 | T | L | A | P | L | E | V | Y | V | 4 | 8001 |
| 8 | L | A | P | L | E | V | Y | V | C | 4 | 8002 |
| 1 | W | I | M | T | P | S | T | L | A | 3 | 8003 |
| 5 | P | S | T | L | A | P | L | E | V | 3 | 8004 |

184P1E2 v.3: HLA Peptide Scoring
Results B4402 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 1 | D | E | F | L | S | F | V | P | V | 15 | 8005 |
| 7 | V | P | V | P | D | G | K | G | P | 15 | 8006 |
| 2 | E | F | L | S | F | V | P | V | P | 5 | 8007 |
| 5 | S | F | V | P | V | P | D | G | K | 5 | 8008 |
| 3 | F | L | S | F | V | P | V | P | D | 3 | 8009 |
| 4 | L | S | F | V | P | V | P | D | G | 3 | 8010 |
| 6 | F | V | P | V | P | D | G | K | G | 2 | 8011 |
| 8 | P | V | P | D | G | K | G | F | R | 2 | 8012 |
| 9 | V | P | D | G | K | G | F | R | M | 2 | 8013 |

TABLE XXXIV

184P1E2 v.1: HLA Peptide Scoring Results B5101 9-mers SYFPEITHI

| Pos | 1 | 2 | 3 | 4 | 5 | 6 | 7 | 8 | 9 | score | SEQ. ID NO. |
|---|---|---|---|---|---|---|---|---|---|---|---|
| 71 | D | A | T | L | E | E | E | V | V | 27 | 8014 |
| 359 | A | P | H | K | T | L | P | V | V | 24 | 8015 |
| 561 | L | A | E | C | D | I | I | D | I | 24 | 8016 |
| 107 | Y | A | V | L | Y | L | T | C | V | 23 | 8017 |
| 282 | S | P | I | F | T | D | T | V | V | 23 | 8018 |
| 434 | L | P | G | S | S | G | R | R | V | 23 | 8019 |
| 510 | R | A | L | L | F | Q | G | V | V | 23 | 8020 |
| 584 | F | P | D | L | V | N | M | L | V | 22 | 8021 |
| 599 | I | P | K | P | F | G | P | I | I | 22 | 8022 |
| 21 | A | G | V | E | T | L | V | D | I | 21 | 8023 |
| 101 | E | P | L | P | L | A | Y | A | V | 21 | 8024 |
| 144 | S | G | Y | G | G | I | L | L | V | 21 | 8025 |
| 326 | L | A | R | K | A | G | C | K | L | 21 | 8026 |
| 358 | Q | A | P | H | K | T | L | P | V | 21 | 8027 |
| 451 | H | A | Q | K | V | Q | P | P | V | 21 | 8028 |
| 559 | L | G | L | A | E | C | D | I | I | 21 | 8029 |
| 105 | L | A | Y | A | V | L | Y | L | T | 20 | 8030 |
| 191 | A | A | L | F | D | D | H | K | L | 20 | 8031 |
| 256 | F | P | D | A | G | F | T | G | L | 20 | 8032 |
| 417 | V | A | N | G | K | E | Y | P | L | 19 | 8033 |
| 438 | S | G | R | R | V | T | Q | V | V | 19 | 8034 |
| 103 | L | P | L | A | Y | A | V | L | Y | 18 | 8035 |
| 142 | G | P | S | G | Y | G | G | I | L | 18 | 8036 |
| 303 | L | P | P | L | E | V | Y | V | C | 18 | 8037 |
| 379 | F | P | Y | K | R | I | L | G | P | 18 | 8038 |
| 518 | V | D | D | E | Q | V | K | T | I | 18 | 8039 |
| 579 | K | A | T | A | F | F | P | D | L | 18 | 8040 |
| 86 | D | L | N | D | S | H | V | Q | I | 17 | 8041 |
| 109 | V | L | Y | L | T | C | V | D | I | 17 | 8042 |
| 141 | W | G | P | S | G | Y | G | G | I | 17 | 8043 |
| 224 | E | A | Y | R | H | V | L | G | Q | 17 | 8044 |
| 304 | P | P | L | E | V | Y | V | C | R | 17 | 8045 |
| 321 | D | A | V | A | E | L | A | R | K | 17 | 8046 |
| 402 | S | G | L | D | S | F | G | N | L | 17 | 8047 |
| 423 | Y | P | L | G | R | I | L | I | G | 17 | 8048 |
| 482 | D | G | K | G | F | R | M | L | L | 17 | 8049 |
| 591 | L | V | G | K | H | L | G | I | I | 17 | 8050 |
| 635 | T | P | Y | H | M | L | H | G | E | 17 | 8051 |
| 16 | S | A | V | C | V | A | G | V | E | 16 | 8052 |
| 158 | D | P | S | C | D | V | Q | D | N | 16 | 8053 |
| 221 | D | V | C | E | A | Y | R | H | V | 16 | 8054 |
| 243 | H | G | D | E | E | R | F | F | V | 16 | 8055 |
| 258 | D | A | G | F | T | G | L | I | S | 16 | 8056 |
| 520 | D | E | Q | V | K | T | I | S | I | 16 | 8057 |
| 581 | T | A | F | F | P | D | L | V | N | 16 | 8058 |
| 13 | H | P | T | S | A | V | C | V | A | 15 | 8059 |
| 20 | V | A | G | V | E | T | L | V | D | 15 | 8060 |
| 44 | G | T | P | G | V | D | I | Y | I | 15 | 8061 |
| 126 | E | G | R | Q | D | R | N | F | V | 15 | 8062 |
| 176 | D | L | E | D | M | S | V | M | V | 15 | 8063 |
| 207 | D | A | K | R | A | Q | V | F | H | 15 | 8064 |
| 285 | F | T | D | T | V | V | F | R | V | 15 | 8065 |
| 289 | V | V | F | R | V | A | P | W | I | 15 | 8066 |
| 413 | S | P | P | V | V | A | N | G | K | 15 | 8067 |
| 456 | Q | P | P | V | E | L | F | V | D | 15 | 8068 |
| 466 | L | A | V | G | H | V | D | E | F | 15 | 8069 |
| 536 | D | L | I | N | Y | N | K | F | V | 15 | 8070 |
| 622 | E | P | L | G | L | H | C | T | F | 15 | 8071 |
| 1 | M | S | L | Q | R | I | V | R | V | 14 | 8072 |
| 177 | L | E | D | M | S | V | M | V | L | 14 | 8073 |
| 208 | A | K | R | A | Q | V | F | H | I | 14 | 8074 |
| 262 | T | G | L | I | S | F | H | V | T | 14 | 8075 |
| 328 | R | K | A | G | C | K | L | T | I | 14 | 8076 |
| 354 | L | G | Y | V | Q | A | P | H | K | 14 | 8077 |
| 376 | L | Q | D | F | P | Y | K | R | I | 14 | 8078 |
| 408 | G | N | L | E | V | S | P | P | V | 14 | 8079 |
| 409 | N | L | E | V | S | P | P | V | V | 14 | 8080 |
| 457 | P | P | V | E | L | F | V | D | W | 14 | 8081 |
| 515 | Q | G | V | V | D | D | E | Q | V | 14 | 8082 |
| 540 | Y | N | K | F | V | Q | S | C | I | 14 | 8083 |
| 601 | K | P | F | G | P | I | I | N | G | 14 | 8084 |
| 12 | E | H | P | T | S | A | V | C | V | 13 | 8085 |
| 33 | V | P | E | G | T | E | M | F | E | 13 | 8086 |
| 35 | E | G | T | E | M | F | E | V | Y | 13 | 8087 |
| 42 | V | Y | G | T | P | G | V | D | I | 13 | 8088 |
| 68 | W | R | F | D | A | T | L | E | I | 13 | 8089 |
| 69 | R | F | D | A | T | L | E | I | I | 13 | 8090 |
| 155 | D | R | D | D | P | S | C | D | V | 13 | 8091 |
| 193 | L | F | D | D | H | K | L | V | L | 13 | 8092 |
| 218 | G | P | E | D | V | C | E | A | Y | 13 | 8093 |
| 276 | N | E | D | F | S | A | S | P | I | 13 | 8094 |
| 293 | V | A | P | W | I | M | T | P | S | 13 | 8095 |
| 299 | T | P | S | T | L | P | P | L | E | 13 | 8096 |
| 329 | K | A | G | C | K | L | T | I | C | 13 | 8097 |
| 337 | C | P | Q | A | E | N | R | N | D | 13 | 8098 |
| 385 | L | G | P | D | F | G | Y | V | T | 13 | 8099 |
| 386 | G | P | D | F | G | Y | V | T | R | 13 | 8100 |
| 414 | P | P | V | V | A | N | G | K | E | 13 | 8101 |
| 455 | V | Q | P | P | V | E | L | F | V | 13 | 8102 |
| 463 | V | D | W | L | A | V | G | H | V | 13 | 8103 |
| 480 | A | P | D | G | K | G | F | R | M | 13 | 8104 |
| 490 | L | A | S | P | G | A | C | F | K | 13 | 8105 |
| 492 | S | P | G | A | C | F | K | L | F | 13 | 8106 |
| 569 | I | P | Q | L | F | K | T | E | R | 13 | 8107 |
| 598 | G | I | P | K | P | F | G | P | I | 13 | 8108 |
| 18 | V | C | V | A | G | V | E | T | L | 12 | 8109 |
| 19 | C | V | A | G | V | E | T | L | V | 12 | 8110 |
| 28 | D | I | Y | G | S | V | P | E | G | 12 | 8111 |
| 45 | T | P | G | V | D | I | Y | I | S | 12 | 8112 |
| 62 | R | A | D | T | R | R | W | R | F | 12 | 8113 |
| 82 | S | P | S | N | D | L | N | D | S | 12 | 8114 |
| 189 | G | P | A | A | L | F | D | D | H | 12 | 8115 |
| 222 | V | C | E | A | Y | R | H | V | L | 12 | 8116 |
| 230 | L | G | Q | D | K | V | S | Y | E | 12 | 8117 |
| 280 | S | A | S | P | I | F | T | D | T | 12 | 8118 |
| 294 | A | P | W | I | M | T | P | S | T | 12 | 8119 |
| 305 | P | L | E | V | Y | V | C | R | V | 12 | 8120 |
| 323 | V | A | E | L | A | R | K | A | G | 12 | 8121 |
| 339 | Q | A | E | N | R | N | D | R | W | 12 | 8122 |
| 356 | Y | V | Q | A | P | H | K | T | L | 12 | 8123 |
| 364 | L | P | V | V | F | D | S | P | R | 12 | 8124 |
| 389 | F | G | Y | V | T | R | E | P | R | 12 | 8125 |
| 395 | E | P | R | D | R | S | V | S | G | 12 | 8126 |
| 404 | L | D | S | F | G | N | L | E | V | 12 | 8127 |
| 419 | N | G | K | E | Y | P | L | G | R | 12 | 8128 |
| 420 | G | K | E | Y | P | L | G | R | I | 12 | 8129 |
| 422 | E | Y | P | L | G | R | I | L | I | 12 | 8130 |
| 447 | R | D | F | L | H | A | Q | K | V | 12 | 8131 |
| 464 | D | W | L | A | V | G | H | V | D | 12 | 8132 |
| 478 | V | P | A | P | D | G | K | G | F | 12 | 8133 |
| 479 | P | A | P | D | G | K | G | F | R | 12 | 8134 |
| 494 | G | A | C | F | K | L | F | Q | E | 12 | 8135 |
| 523 | V | K | T | I | S | I | N | Q | V | 12 | 8136 |
| 530 | Q | V | L | S | N | K | D | L | I | 12 | 8137 |
| 583 | F | F | P | D | L | V | N | M | L | 12 | 8138 |
| 585 | P | D | L | V | N | M | L | V | L | 12 | 8139 |
| 612 | C | L | E | E | K | V | R | S | L | 12 | 8140 |
| 632 | D | D | F | T | P | Y | H | M | L | 12 | 8141 |
| 655 | F | S | F | K | W | W | N | M | V | 12 | 8142 |
| 3 | L | Q | R | I | V | R | V | S | L | 11 | 8143 |
| 15 | T | S | A | V | C | V | A | G | V | 11 | 8144 |
| 49 | D | I | Y | I | S | P | N | M | E | 11 | 8145 |
| 53 | S | P | N | M | E | R | G | R | E | 11 | 8146 |
| 58 | R | G | R | E | R | A | D | T | R | 11 | 8147 |
| 70 | F | D | A | T | L | E | I | I | V | 11 | 8148 |
| 111 | Y | L | T | C | V | D | I | S | L | 11 | 8149 |
| 132 | N | F | V | D | K | R | Q | W | V | 11 | 8150 |
| 190 | P | A | A | L | F | D | D | H | K | 11 | 8151 |
| 192 | A | L | F | D | D | H | K | L | V | 11 | 8152 |
| 210 | R | A | Q | V | F | H | I | C | G | 11 | 8153 |
| 217 | C | G | P | E | D | V | C | E | A | 11 | 8154 |
| 231 | G | Q | D | K | V | S | Y | E | V | 11 | 8155 |
| 235 | V | S | Y | E | V | P | R | L | H | 11 | 8156 |
| 239 | V | P | R | L | H | G | D | E | E | 11 | 8157 |
| 257 | P | D | A | G | F | T | G | L | I | 11 | 8158 |
| 264 | L | I | S | F | H | V | T | L | L | 11 | 8159 |
| 281 | A | S | P | I | F | T | D | T | V | 11 | 8160 |
| 302 | T | L | P | P | L | E | V | Y | V | 11 | 8161 |
| 315 | N | N | T | C | F | V | D | A | V | 11 | 8162 |

TABLE XXXIV-continued

| Pos | 1 | 2 | 3 | 4 | 5 | 6 | 7 | 8 | 9 | score | SEQ. ID NO. |
|---|---|---|---|---|---|---|---|---|---|---|---|
| 340 | A | E | N | R | N | D | R | W | I | 11 | 8163 |
| 370 | S | P | R | N | G | E | L | Q | D | 11 | 8164 |
| 384 | I | L | G | P | D | F | G | Y | V | 11 | 8165 |
| 421 | K | E | Y | P | L | G | R | I | L | 11 | 8166 |
| 437 | S | S | G | R | R | V | T | Q | V | 11 | 8167 |
| 470 | H | V | D | E | F | L | S | F | V | 11 | 8168 |
| 546 | S | C | I | D | W | N | R | E | V | 11 | 8169 |
| 589 | N | M | L | V | L | G | K | H | L | 11 | 8170 |
| 613 | L | E | E | K | V | R | S | L | L | 11 | 8171 |
| 623 | P | L | G | L | H | C | T | F | I | 11 | 8172 |
| 646 | C | G | T | N | V | C | R | K | P | 11 | 8173 |
| 653 | K | P | F | S | F | K | W | W | N | 11 | 8174 |
| 25 | T | L | V | D | I | Y | G | S | V | 10 | 8175 |
| 30 | Y | G | S | V | P | E | G | T | E | 10 | 8176 |
| 41 | E | V | Y | G | T | P | G | V | D | 10 | 8177 |
| 43 | Y | G | T | P | G | V | D | I | Y | 10 | 8178 |
| 102 | P | L | P | L | A | Y | A | V | L | 10 | 8179 |
| 146 | Y | G | G | I | L | L | V | N | C | 10 | 8180 |
| 163 | V | Q | D | N | C | D | Q | H | V | 10 | 8181 |
| 174 | L | Q | D | L | E | D | M | S | V | 10 | 8182 |
| 205 | S | Y | D | A | K | R | A | Q | V | 10 | 8183 |
| 214 | F | H | I | C | G | P | E | D | V | 10 | 8184 |
| 227 | R | H | V | L | G | Q | D | K | V | 10 | 8185 |
| 259 | A | G | F | T | G | L | I | S | F | 10 | 8186 |
| 261 | F | T | G | L | I | S | F | H | V | 10 | 8187 |
| 295 | P | W | I | M | T | P | S | T | L | 10 | 8188 |
| 298 | M | T | P | S | T | L | P | P | L | 10 | 8189 |
| 300 | P | S | T | L | P | P | L | E | V | 10 | 8190 |
| 393 | T | R | E | P | R | D | R | S | V | 10 | 8191 |
| 405 | D | S | F | G | N | L | E | V | S | 10 | 8192 |
| 435 | P | G | S | S | G | R | R | V | T | 10 | 8193 |
| 448 | D | F | L | H | A | Q | K | V | Q | 10 | 8194 |
| 460 | E | L | F | V | D | W | L | A | V | 10 | 8195 |
| 484 | K | G | F | R | M | L | L | A | S | 10 | 8196 |
| 491 | A | S | P | G | A | C | F | K | L | 10 | 8197 |
| 524 | K | T | I | S | I | N | Q | V | L | 10 | 8198 |
| 529 | N | Q | V | L | S | N | K | D | L | 10 | 8199 |
| 553 | E | V | L | K | R | E | L | G | L | 10 | 8200 |
| 558 | E | L | G | L | A | E | C | D | I | 10 | 8201 |
| 597 | L | G | I | P | K | P | F | G | P | 10 | 8202 |
| 604 | G | P | I | I | N | G | C | C | C | 10 | 8203 |
| 609 | G | C | C | C | L | E | E | K | V | 10 | 8204 |
| 618 | R | S | L | L | E | P | L | G | L | 10 | 8205 |
| 624 | L | G | L | H | C | T | F | I | D | 10 | 8206 |
| 34 | P | E | G | T | E | M | F | E | V | 9 | 8207 |
| 40 | F | E | V | Y | G | T | P | G | V | 9 | 8208 |
| 66 | R | R | W | R | F | D | A | T | L | 9 | 8209 |
| 72 | A | T | L | E | I | I | V | V | M | 9 | 8210 |
| 84 | S | N | D | L | N | D | S | H | V | 9 | 8211 |
| 104 | P | L | A | Y | A | V | L | Y | L | 9 | 8212 |
| 147 | G | G | I | L | L | V | N | C | D | 9 | 8213 |
| 166 | N | C | D | Q | H | V | H | C | L | 9 | 8214 |
| 179 | D | M | S | V | M | V | L | R | T | 9 | 8215 |
| 185 | L | R | T | Q | G | P | A | A | L | 9 | 8216 |
| 188 | Q | G | P | A | A | L | F | D | D | 9 | 8217 |
| 195 | D | D | H | K | L | V | L | H | T | 9 | 8218 |
| 196 | D | H | K | L | V | L | H | T | S | 9 | 8219 |
| 234 | K | V | S | Y | E | V | P | R | L | 9 | 8220 |
| 252 | E | G | L | S | F | P | D | A | G | 9 | 8221 |
| 263 | G | L | I | S | F | H | V | T | L | 9 | 8222 |
| 318 | C | F | V | D | A | V | A | E | L | 9 | 8223 |
| 349 | Q | D | E | M | E | L | G | Y | V | 9 | 8224 |
| 350 | D | E | M | E | L | G | Y | V | Q | 9 | 8225 |
| 377 | Q | D | F | P | Y | K | R | I | L | 9 | 8226 |
| 396 | P | R | D | R | S | V | S | G | L | 9 | 8227 |
| 407 | F | G | N | L | E | V | S | P | P | 9 | 8228 |
| 425 | L | G | R | I | L | I | G | G | N | 9 | 8229 |
| 430 | I | G | G | N | L | P | G | S | S | 9 | 8230 |
| 442 | V | T | Q | V | V | R | D | F | L | 9 | 8231 |
| 481 | P | D | G | K | G | F | R | M | L | 9 | 8232 |
| 506 | C | G | H | G | R | A | L | L | F | 9 | 8233 |
| 509 | G | R | A | L | L | F | Q | V | S | 9 | 8234 |
| 538 | I | N | Y | N | K | F | V | Q | S | 9 | 8235 |
| 547 | C | I | D | W | N | R | E | V | L | 9 | 8236 |
| 549 | D | W | N | R | E | V | L | K | R | 9 | 8237 |
| 568 | D | I | P | Q | L | F | K | T | E | 9 | 8238 |
| 580 | A | T | A | F | F | P | D | L | V | 9 | 8239 |
| 593 | L | G | K | H | L | G | I | P | K | 9 | 8240 |
| 603 | F | G | P | I | I | N | G | C | C | 9 | 8241 |
| 642 | G | E | V | H | C | G | T | N | V | 9 | 8242 |
| 10 | S | L | E | H | P | T | S | A | V | 8 | 8243 |
| 46 | P | G | V | D | I | Y | I | S | P | 8 | 8244 |
| 79 | V | M | N | S | P | S | N | D | L | 8 | 8245 |
| 97 | H | S | S | H | E | P | L | P | L | 8 | 8246 |
| 130 | D | R | N | F | V | D | K | R | Q | 8 | 8247 |
| 246 | E | E | R | F | F | V | E | G | L | 8 | 8248 |
| 278 | D | F | S | A | S | P | I | F | T | 8 | 8249 |
| 286 | T | D | T | V | V | F | R | V | A | 8 | 8250 |
| 306 | L | E | V | Y | V | C | R | V | R | 8 | 8251 |
| 312 | R | V | R | N | N | T | C | F | V | 8 | 8252 |
| 330 | A | G | C | K | L | T | I | C | P | 8 | 8253 |
| 368 | F | D | S | P | R | N | G | E | L | 8 | 8254 |
| 453 | Q | K | V | Q | P | P | V | E | L | 8 | 8255 |
| 458 | P | V | E | L | F | V | D | W | L | 8 | 8256 |
| 467 | A | V | G | H | V | D | E | F | L | 8 | 8257 |
| 472 | D | E | F | L | S | F | V | P | A | 8 | 8258 |
| 504 | Q | K | C | G | H | G | R | A | L | 8 | 8259 |
| 508 | H | G | R | A | L | L | F | Q | G | 8 | 8260 |
| 551 | N | R | E | V | L | K | R | E | L | 8 | 8261 |
| 608 | N | G | C | C | C | L | E | E | K | 8 | 8262 |
| 636 | P | Y | H | M | L | H | G | E | V | 8 | 8263 |
| 641 | H | G | E | V | H | C | G | T | N | 8 | 8264 |
| 9 | V | S | L | E | H | P | T | S | A | 7 | 8265 |
| 38 | E | M | F | E | V | Y | G | T | P | 7 | 8266 |
| 94 | I | S | Y | H | S | S | H | E | P | 7 | 8267 |
| 95 | S | Y | H | S | S | H | E | P | L | 7 | 8268 |
| 110 | L | Y | L | T | C | V | D | I | S | 7 | 8269 |
| 115 | V | D | I | S | L | D | C | D | L | 7 | 8270 |
| 143 | P | S | G | Y | G | G | I | L | L | 7 | 8271 |
| 165 | N | C | D | Q | H | V | H | C | L | 7 | 8272 |
| 169 | Q | H | V | H | C | L | Q | D | L | 7 | 8273 |
| 175 | Q | D | L | E | D | M | S | V | M | 7 | 8274 |
| 180 | M | S | V | M | V | L | R | T | Q | 7 | 8275 |
| 206 | Y | D | A | K | R | A | Q | V | F | 7 | 8276 |
| 228 | H | V | L | G | Q | D | K | V | S | 7 | 8277 |
| 274 | D | S | N | E | D | F | S | A | S | 7 | 8278 |
| 284 | I | F | T | D | T | V | V | F | R | 7 | 8279 |
| 352 | M | E | L | G | Y | V | Q | A | P | 7 | 8280 |
| 373 | N | G | E | L | Q | D | F | P | Y | 7 | 8281 |
| 378 | D | F | P | Y | K | R | I | L | G | 7 | 8282 |
| 387 | P | D | F | G | Y | V | T | R | E | 7 | 8283 |
| 388 | D | F | G | Y | V | T | R | E | P | 7 | 8284 |
| 410 | L | E | V | S | P | P | V | V | A | 7 | 8285 |
| 461 | L | F | V | D | W | L | A | V | G | 7 | 8286 |
| 468 | V | G | H | V | D | E | F | L | S | 7 | 8287 |
| 493 | P | G | A | C | F | K | L | F | Q | 7 | 8288 |
| 513 | L | F | Q | G | V | V | D | D | E | 7 | 8289 |
| 519 | D | D | E | Q | V | K | T | I | S | 7 | 8290 |
| 550 | W | N | R | E | V | L | K | R | E | 7 | 8291 |
| 564 | C | D | I | I | D | I | P | Q | L | 7 | 8292 |
| 586 | D | L | V | N | M | L | V | L | G | 7 | 8293 |
| 616 | K | V | R | S | L | L | E | P | L | 7 | 8294 |
| 2 | S | L | Q | R | I | V | R | V | S | 6 | 8295 |
| 11 | L | E | H | P | T | S | A | V | C | 6 | 8296 |
| 26 | L | V | D | I | Y | G | S | V | P | 6 | 8297 |
| 74 | L | E | I | I | V | V | M | N | S | 6 | 8298 |
| 85 | N | D | L | N | D | S | H | V | Q | 6 | 8299 |
| 117 | I | S | L | D | C | D | L | N | C | 6 | 8300 |
| 135 | D | K | R | Q | W | V | W | G | P | 6 | 8301 |
| 145 | G | Y | G | G | I | L | L | V | N | 6 | 8302 |
| 157 | D | D | P | S | C | D | V | Q | D | 6 | 8303 |
| 204 | S | S | Y | D | A | K | R | A | Q | 6 | 8304 |
| 233 | D | K | V | S | Y | E | V | P | R | 6 | 8305 |
| 244 | G | D | E | E | R | F | F | V | E | 6 | 8306 |
| 245 | D | E | E | R | F | F | V | E | G | 6 | 8307 |
| 265 | I | S | F | H | V | T | L | L | D | 6 | 8308 |
| 283 | P | I | F | T | D | T | V | V | F | 6 | 8309 |
| 301 | S | T | L | P | P | L | E | V | Y | 6 | 8310 |
| 307 | E | V | Y | V | C | R | V | R | N | 6 | 8311 |
| 316 | N | T | C | F | V | D | A | V | A | 6 | 8312 |
| 322 | A | V | A | E | L | A | R | K | A | 6 | 8313 |
| 346 | R | W | I | Q | D | E | M | E | L | 6 | 8314 |

TABLE XXXIV-continued

| Pos | 1 | 2 | 3 | 4 | 5 | 6 | 7 | 8 | 9 | score | SEQ. ID NO. |
|---|---|---|---|---|---|---|---|---|---|---|---|
| 348 | I | Q | D | E | M | E | L | G | Y | 6 | 8315 |
| 360 | P | H | K | T | L | P | V | V | F | 6 | 8316 |
| 362 | K | T | L | P | V | V | F | D | S | 6 | 8317 |
| 366 | V | V | F | D | S | P | R | N | G | 6 | 8318 |
| 398 | D | R | S | V | S | G | L | D | S | 6 | 8319 |
| 412 | V | S | P | P | V | V | A | N | G | 6 | 8320 |
| 426 | G | R | I | L | I | G | G | N | L | 6 | 8321 |
| 431 | G | G | N | L | P | G | S | S | G | 6 | 8322 |
| 488 | M | L | L | A | S | P | G | A | C | 6 | 8323 |
| 499 | L | F | Q | E | K | Q | K | C | G | 6 | 8324 |
| 505 | K | C | G | H | G | R | A | L | L | 6 | 8325 |
| 511 | A | L | L | F | Q | G | V | V | D | 6 | 8326 |
| 512 | L | L | F | Q | G | V | V | D | D | 6 | 8327 |
| 565 | D | I | I | D | I | P | Q | L | F | 6 | 8328 |
| 571 | Q | L | F | K | T | E | R | K | K | 6 | 8329 |
| 572 | L | F | K | T | E | R | K | K | A | 6 | 8330 |
| 588 | V | N | M | L | V | L | G | K | H | 6 | 8331 |
| 605 | P | I | I | N | G | C | C | C | L | 6 | 8332 |
| 611 | C | C | L | E | E | K | V | R | S | 6 | 8333 |
| 640 | L | H | G | E | V | H | C | G | T | 6 | 8334 |
| 6 | I | V | R | V | S | L | E | H | P | 5 | 8335 |
| 29 | I | Y | G | S | V | P | E | G | T | 5 | 8336 |
| 52 | I | S | P | N | M | E | R | G | R | 5 | 8337 |
| 89 | D | S | H | V | Q | I | S | Y | H | 5 | 8338 |
| 108 | A | V | L | Y | L | T | C | V | D | 5 | 8339 |
| 122 | D | L | N | C | E | G | R | Q | D | 5 | 8340 |
| 127 | G | R | Q | D | R | N | F | V | D | 5 | 8341 |
| 133 | F | V | D | K | R | Q | W | V | W | 5 | 8342 |
| 148 | G | I | L | L | V | N | C | D | R | 5 | 8343 |
| 149 | I | L | L | V | N | C | D | R | D | 5 | 8344 |
| 162 | D | V | Q | D | N | C | D | Q | H | 5 | 8345 |
| 168 | D | Q | H | V | H | C | L | Q | D | 5 | 8346 |
| 199 | L | V | L | H | T | S | S | Y | D | 5 | 8347 |
| 270 | T | L | L | D | D | S | N | E | D | 5 | 8348 |
| 271 | L | L | D | D | S | N | E | D | F | 5 | 8349 |
| 287 | D | T | V | V | F | R | V | A | P | 5 | 8350 |
| 309 | Y | V | C | R | V | R | N | N | T | 5 | 8351 |
| 310 | V | C | R | V | R | N | N | T | C | 5 | 8352 |
| 313 | V | R | N | N | T | C | F | V | D | 5 | 8353 |
| 319 | F | V | D | A | V | A | E | L | A | 5 | 8354 |
| 336 | I | C | P | Q | A | E | N | R | N | 5 | 8355 |
| 345 | D | R | W | I | Q | D | E | M | E | 5 | 8356 |
| 363 | T | L | P | V | V | F | D | S | P | 5 | 8357 |
| 369 | D | S | P | R | N | G | E | L | Q | 5 | 8358 |
| 428 | I | L | I | G | G | N | L | P | G | 5 | 8359 |
| 433 | N | L | P | G | S | S | G | R | R | 5 | 8360 |
| 439 | G | R | R | V | T | Q | V | V | R | 5 | 8361 |
| 440 | R | R | V | T | Q | V | V | R | D | 5 | 8362 |
| 441 | R | V | T | Q | V | V | R | D | F | 5 | 8363 |
| 450 | L | H | A | Q | K | V | Q | P | P | 5 | 8364 |
| 459 | V | E | L | F | V | D | W | L | A | 5 | 8365 |
| 477 | F | V | P | A | P | D | G | K | G | 5 | 8366 |
| 517 | V | V | D | D | E | Q | V | K | T | 5 | 8367 |
| 526 | I | S | I | N | Q | V | L | S | N | 5 | 8368 |
| 528 | I | N | Q | V | L | S | N | K | D | 5 | 8369 |
| 532 | L | S | N | K | D | L | I | N | Y | 5 | 8370 |
| 535 | K | D | L | I | N | Y | N | K | F | 5 | 8371 |
| 537 | L | I | N | Y | N | K | F | V | Q | 5 | 8372 |
| 555 | L | K | R | E | L | G | L | A | E | 5 | 8373 |
| 567 | I | D | I | P | Q | L | F | K | T | 5 | 8374 |
| 575 | T | E | R | K | K | A | T | A | F | 5 | 8375 |
| 587 | L | V | N | M | L | V | L | G | K | 5 | 8376 |
| 595 | K | H | L | G | I | P | K | P | F | 5 | 8377 |
| 619 | S | L | L | E | P | L | G | L | H | 5 | 8378 |
| 631 | I | D | D | F | T | P | Y | H | M | 5 | 8379 |
| 633 | D | F | T | P | Y | H | M | L | H | 5 | 8380 |
| 637 | Y | H | M | L | H | G | E | V | H | 5 | 8381 |
| 644 | V | H | C | G | T | N | V | C | R | 5 | 8382 |
| 14 | P | T | S | A | V | C | V | A | G | 4 | 8383 |
| 23 | V | E | T | L | V | D | I | Y | G | 4 | 8384 |
| 64 | D | T | R | R | W | F | D | A | R | 4 | 8385 |
| 73 | T | L | E | I | V | V | M | N | P | 4 | 8386 |
| 76 | I | V | V | M | N | S | P | S | N | 4 | 8387 |
| 87 | L | N | D | S | H | V | Q | I | S | 4 | 8388 |
| 88 | N | D | S | H | V | Q | I | S | Y | 4 | 8389 |
| 116 | D | I | S | L | D | C | D | L | N | 4 | 8390 |
| 119 | L | D | C | D | L | N | C | E | G | 4 | 8391 |
| 120 | D | C | D | L | N | C | E | G | R | 4 | 8392 |
| 123 | L | N | C | E | G | R | Q | D | R | 4 | 8393 |
| 129 | Q | D | R | N | F | V | D | K | R | 4 | 8394 |
| 156 | R | D | D | P | S | C | D | V | Q | 4 | 8395 |
| 183 | M | V | L | R | T | Q | G | P | A | 4 | 8396 |
| 194 | F | D | D | H | K | L | V | L | H | 4 | 8397 |
| 203 | T | S | S | Y | D | A | K | R | A | 4 | 8398 |
| 215 | H | I | C | G | P | E | D | V | C | 4 | 8399 |
| 232 | Q | D | K | V | S | Y | E | V | P | 4 | 8400 |
| 242 | L | H | G | D | E | E | R | F | F | 4 | 8401 |
| 249 | F | F | V | E | G | L | S | F | P | 4 | 8402 |
| 254 | L | S | F | P | D | A | G | F | T | 4 | 8403 |
| 255 | S | F | P | D | A | G | F | T | G | 4 | 8404 |
| 273 | D | D | S | N | E | D | F | S | A | 4 | 8405 |
| 279 | F | S | A | S | P | I | F | T | D | 4 | 8406 |
| 297 | I | M | T | P | S | T | L | P | P | 4 | 8407 |
| 308 | V | Y | V | C | R | V | R | N | N | 4 | 8408 |
| 317 | T | C | F | V | D | A | V | A | E | 4 | 8409 |
| 375 | E | L | Q | D | F | P | Y | K | R | 4 | 8410 |
| 391 | Y | V | T | R | E | P | R | D | R | 4 | 8411 |
| 392 | V | T | R | E | P | R | D | R | S | 4 | 8412 |
| 394 | R | E | P | R | D | R | S | V | S | 4 | 8413 |
| 429 | L | I | G | G | N | L | P | G | S | 4 | 8414 |
| 436 | G | S | S | G | R | R | V | T | Q | 4 | 8415 |
| 452 | A | Q | K | V | Q | P | P | V | E | 4 | 8416 |
| 471 | V | D | E | F | L | S | F | V | P | 4 | 8417 |
| 473 | E | F | L | S | F | V | P | A | P | 4 | 8418 |
| 474 | F | L | S | F | V | P | A | P | D | 4 | 8419 |
| 475 | L | S | F | V | P | A | P | D | G | 4 | 8420 |
| 497 | F | K | L | F | Q | E | K | Q | K | 4 | 8421 |
| 516 | G | V | V | D | D | E | Q | V | K | 4 | 8422 |
| 539 | N | Y | N | K | F | V | Q | S | C | 4 | 8423 |
| 548 | I | D | W | N | R | E | V | L | K | 4 | 8424 |
| 557 | R | E | L | G | L | A | E | C | D | 4 | 8425 |
| 570 | P | Q | L | F | K | T | E | R | K | 4 | 8426 |
| 573 | F | K | T | E | R | K | K | A | T | 4 | 8427 |
| 610 | C | C | L | E | E | K | V | R | K | 4 | 8428 |
| 620 | L | L | E | P | L | G | L | H | C | 4 | 8429 |
| 621 | L | E | P | L | G | L | H | C | T | 4 | 8430 |
| 626 | L | H | C | T | F | I | D | D | F | 4 | 8431 |
| 629 | T | F | I | D | D | F | T | P | Y | 4 | 8432 |
| 634 | F | T | P | Y | H | M | L | H | G | 4 | 8433 |
| 638 | H | M | L | H | G | E | V | H | C | 4 | 8434 |
| 639 | M | L | H | G | E | V | H | C | G | 4 | 8435 |
| 643 | E | V | H | C | G | T | N | V | C | 4 | 8436 |
| 645 | H | C | G | T | N | V | C | R | K | 4 | 8437 |
| 652 | R | K | P | F | S | F | K | W | W | 4 | 8438 |
| 656 | S | F | K | W | W | N | M | V | P | 4 | 8439 |
| 5 | R | I | V | R | V | S | L | E | H | 3 | 8440 |
| 22 | G | V | E | T | L | V | D | I | Y | 3 | 8441 |
| 24 | E | T | L | V | D | I | Y | G | S | 3 | 8442 |
| 32 | S | V | P | E | G | T | E | M | F | 3 | 8443 |
| 37 | T | E | M | F | E | V | Y | G | T | 3 | 8444 |
| 39 | M | F | E | V | Y | G | T | P | G | 3 | 8445 |
| 50 | I | Y | I | S | P | N | M | E | R | 3 | 8446 |
| 51 | Y | I | S | P | N | M | E | R | G | 3 | 8447 |
| 54 | P | N | M | E | R | G | R | E | R | 3 | 8448 |
| 56 | M | E | R | G | R | E | R | R | R | 3 | 8449 |
| 60 | R | E | R | A | D | T | R | R | W | 3 | 8450 |
| 61 | E | R | A | D | T | R | R | W | R | 3 | 8451 |
| 75 | E | I | I | V | V | M | N | S | P | 3 | 8452 |
| 78 | V | V | M | N | S | P | S | N | D | 3 | 8453 |
| 80 | M | N | S | P | S | N | D | L | N | 3 | 8454 |
| 81 | N | S | P | S | N | D | L | N | D | 3 | 8455 |
| 98 | S | S | H | E | P | L | P | L | A | 3 | 8456 |
| 106 | A | Y | A | V | L | Y | L | T | C | 3 | 8457 |
| 112 | L | T | C | V | D | I | S | L | D | 3 | 8458 |
| 113 | T | C | V | D | I | S | L | D | C | 3 | 8459 |
| 121 | C | D | L | N | C | E | G | R | Q | 3 | 8460 |
| 124 | N | C | E | G | R | Q | D | R | N | 3 | 8461 |
| 150 | L | L | V | N | C | D | R | D | Q | 3 | 8462 |
| 159 | P | S | C | D | V | Q | D | N | C | 3 | 8463 |
| 164 | Q | D | N | C | D | Q | H | V | H | 3 | 8464 |
| 172 | H | C | L | Q | D | L | E | D | M | 3 | 8465 |
| 178 | E | D | M | S | V | M | V | L | R | 3 | 8466 |

TABLE XXXIV-continued

| Pos | 1 | 2 | 3 | 4 | 5 | 6 | 7 | 8 | 9 | score | SEQ. ID NO. |
|---|---|---|---|---|---|---|---|---|---|---|---|
| 187 | T | Q | G | P | A | A | L | F | D | 3 | 8467 |
| 197 | H | K | L | V | L | H | T | S | S | 3 | 8468 |
| 200 | V | L | H | T | S | S | Y | D | A | 3 | 8469 |
| 201 | L | H | T | S | S | Y | D | A | K | 3 | 8470 |
| 202 | H | T | S | S | Y | D | A | K | R | 3 | 8471 |
| 209 | K | R | A | Q | V | F | H | I | C | 3 | 8472 |
| 216 | I | C | G | P | E | D | V | C | E | 3 | 8473 |
| 225 | A | Y | R | H | V | L | G | Q | D | 3 | 8474 |
| 237 | Y | E | V | P | R | L | H | G | D | 3 | 8475 |
| 247 | E | R | F | F | V | E | G | L | S | 3 | 8476 |
| 251 | V | E | G | L | S | F | P | D | A | 3 | 8477 |
| 266 | S | F | H | V | T | L | L | D | D | 3 | 8478 |
| 267 | F | H | V | T | L | L | D | D | S | 3 | 8479 |
| 269 | V | T | L | L | D | D | S | N | E | 3 | 8480 |
| 288 | T | V | V | F | R | V | A | P | W | 3 | 8481 |
| 291 | F | R | V | A | P | W | I | M | T | 3 | 8482 |
| 292 | R | V | A | P | W | I | M | T | P | 3 | 8483 |
| 314 | R | N | N | T | C | F | V | D | A | 3 | 8484 |
| 324 | A | E | L | A | R | K | A | G | C | 3 | 8485 |
| 332 | C | K | L | T | I | C | P | Q | A | 3 | 8486 |
| 338 | P | Q | A | E | N | R | N | D | R | 3 | 8487 |
| 342 | N | R | N | D | R | W | I | Q | D | 3 | 8488 |
| 355 | G | Y | V | Q | A | P | H | K | T | 3 | 8489 |
| 361 | H | K | T | L | P | V | V | F | D | 3 | 8490 |
| 374 | G | E | L | Q | D | F | P | Y | K | 3 | 8491 |
| 383 | R | I | L | G | P | D | F | G | Y | 3 | 8492 |
| 411 | E | V | S | P | P | V | V | A | N | 3 | 8493 |
| 427 | R | I | L | I | G | G | N | L | P | 3 | 8494 |
| 444 | Q | V | V | R | D | F | L | H | A | 3 | 8495 |
| 445 | V | V | R | D | F | L | H | A | Q | 3 | 8496 |
| 449 | F | L | H | A | Q | K | V | Q | P | 3 | 8497 |
| 462 | F | V | D | W | L | A | V | G | H | 3 | 8498 |
| 469 | G | H | V | D | E | F | L | S | F | 3 | 8499 |
| 495 | A | C | F | K | L | F | Q | E | K | 3 | 8500 |
| 498 | K | L | F | Q | E | K | Q | K | C | 3 | 8501 |
| 514 | F | Q | G | V | V | D | D | E | Q | 3 | 8502 |
| 521 | E | Q | V | K | T | I | S | I | N | 3 | 8503 |
| 527 | S | I | N | Q | V | L | S | N | K | 3 | 8504 |
| 531 | V | L | S | N | K | D | L | I | N | 3 | 8505 |
| 533 | S | N | K | D | L | I | N | Y | N | 3 | 8506 |
| 560 | G | L | A | E | C | D | I | I | D | 3 | 8507 |
| 566 | I | I | D | I | P | Q | L | F | K | 3 | 8508 |
| 574 | K | T | E | R | K | K | A | T | A | 3 | 8509 |
| 577 | R | K | K | A | T | A | F | F | P | 3 | 8510 |
| 582 | A | F | F | P | D | L | V | N | M | 3 | 8511 |
| 592 | V | L | G | K | H | L | G | I | P | 3 | 8512 |
| 594 | G | K | H | L | G | I | P | K | P | 3 | 8513 |
| 600 | P | K | P | F | G | P | I | I | N | 3 | 8514 |
| 606 | I | I | N | G | C | C | C | L | E | 3 | 8515 |
| 607 | I | N | G | C | C | C | L | E | E | 3 | 8516 |
| 615 | E | K | V | R | S | L | L | E | P | 3 | 8517 |
| 625 | G | L | H | C | T | F | I | D | D | 3 | 8518 |
| 628 | C | T | F | I | D | D | F | T | P | 3 | 8519 |
| 649 | N | V | C | R | K | P | F | S | F | 3 | 8520 |
| 650 | V | C | R | K | P | F | S | F | K | 3 | 8521 |
| 4 | Q | R | I | V | R | V | S | L | E | 2 | 8522 |
| 8 | R | V | S | L | E | H | P | T | S | 2 | 8523 |
| 27 | V | D | I | Y | G | S | V | P | E | 2 | 8524 |
| 47 | G | V | D | I | Y | I | S | P | N | 2 | 8525 |
| 55 | N | M | E | R | G | R | E | R | A | 2 | 8526 |
| 59 | G | R | E | R | A | D | T | R | R | 2 | 8527 |
| 65 | T | R | R | W | R | F | D | A | T | 2 | 8528 |
| 67 | R | W | R | F | D | A | T | L | E | 2 | 8529 |
| 77 | I | V | V | M | N | S | P | S | N | 2 | 8530 |
| 83 | P | S | N | D | L | N | D | S | H | 2 | 8531 |
| 92 | V | Q | I | S | Y | H | S | S | H | 2 | 8532 |
| 96 | Y | H | S | S | H | E | P | L | P | 2 | 8533 |
| 99 | S | H | E | P | L | P | L | A | Y | 2 | 8534 |
| 100 | H | E | P | L | P | L | A | Y | A | 2 | 8535 |
| 114 | C | V | D | I | S | L | D | C | D | 2 | 8536 |
| 118 | S | L | D | C | D | L | N | C | E | 2 | 8537 |
| 128 | R | Q | D | R | N | F | V | D | K | 2 | 8538 |
| 131 | R | N | F | V | D | K | R | Q | W | 2 | 8539 |
| 134 | V | D | K | R | Q | W | V | W | G | 2 | 8540 |
| 136 | K | R | Q | W | V | W | G | P | S | 2 | 8541 |
| 139 | W | V | W | G | P | S | G | Y | G | 2 | 8542 |
| 140 | V | W | G | P | S | G | Y | G | G | 2 | 8543 |
| 151 | L | V | N | C | D | R | D | D | P | 2 | 8544 |
| 152 | V | N | C | D | R | D | D | P | S | 2 | 8545 |
| 154 | C | D | R | D | D | P | S | C | D | 2 | 8546 |
| 167 | C | D | Q | H | V | H | C | L | Q | 2 | 8547 |
| 171 | V | H | C | L | Q | D | L | E | D | 2 | 8548 |
| 184 | V | L | R | T | Q | G | P | A | A | 2 | 8549 |
| 186 | R | T | Q | G | P | A | A | L | F | 2 | 8550 |
| 220 | E | D | V | C | E | A | Y | R | H | 2 | 8551 |
| 226 | Y | R | H | V | L | G | Q | D | K | 2 | 8552 |
| 229 | V | L | G | Q | D | K | V | S | Y | 2 | 8553 |
| 236 | S | Y | E | V | P | R | L | H | G | 2 | 8554 |
| 240 | P | R | L | H | G | D | E | E | R | 2 | 8555 |
| 241 | R | L | H | G | D | E | E | R | F | 2 | 8556 |
| 248 | R | F | F | V | E | G | L | S | F | 2 | 8557 |
| 250 | F | V | E | G | L | S | F | P | D | 2 | 8558 |
| 260 | G | F | T | G | L | I | S | F | H | 2 | 8559 |
| 272 | L | D | D | S | N | E | D | F | S | 2 | 8560 |
| 290 | V | F | R | V | A | P | W | I | M | 2 | 8561 |
| 296 | W | I | M | T | P | S | T | L | P | 2 | 8562 |
| 311 | C | R | V | R | N | N | T | C | F | 2 | 8563 |
| 320 | V | D | A | V | A | E | L | A | R | 2 | 8564 |
| 325 | E | L | A | R | K | A | G | C | K | 2 | 8565 |
| 327 | A | R | K | A | G | C | K | L | T | 2 | 8566 |
| 331 | G | C | K | L | T | I | C | P | Q | 2 | 8567 |
| 334 | L | T | I | C | P | Q | A | E | N | 2 | 8568 |
| 335 | T | I | C | P | Q | A | E | N | R | 2 | 8569 |
| 353 | E | L | G | Y | V | Q | A | P | H | 2 | 8570 |
| 357 | V | Q | A | P | H | K | T | L | P | 2 | 8571 |
| 367 | V | F | D | S | P | R | N | G | E | 2 | 8572 |
| 371 | P | R | N | G | E | L | Q | D | F | 2 | 8573 |
| 372 | R | N | G | E | L | Q | D | F | P | 2 | 8574 |
| 381 | Y | K | R | I | L | G | P | D | F | 2 | 8575 |
| 390 | G | Y | V | T | R | E | P | R | D | 2 | 8576 |
| 397 | R | D | R | S | V | S | G | L | D | 2 | 8577 |
| 415 | P | V | V | A | N | G | K | E | Y | 2 | 8578 |
| 424 | P | L | G | R | I | L | I | G | G | 2 | 8579 |
| 432 | G | N | L | P | G | S | S | G | R | 2 | 8580 |
| 454 | K | V | Q | P | P | V | E | L | F | 2 | 8581 |
| 486 | F | R | M | L | L | A | S | P | G | 2 | 8582 |
| 487 | R | M | L | L | A | S | P | G | A | 2 | 8583 |
| 489 | L | L | A | S | P | G | A | C | F | 2 | 8584 |
| 496 | C | F | K | L | F | Q | E | K | Q | 2 | 8585 |
| 500 | F | Q | E | K | Q | K | C | G | H | 2 | 8586 |
| 501 | Q | E | K | Q | K | C | G | H | G | 2 | 8587 |
| 507 | G | H | G | R | A | L | L | F | Q | 2 | 8588 |
| 522 | Q | V | K | T | I | S | I | N | Q | 2 | 8589 |
| 525 | T | I | S | I | N | Q | V | L | S | 2 | 8590 |
| 534 | N | K | D | L | I | N | Y | N | K | 2 | 8591 |
| 541 | N | K | F | V | Q | S | C | I | D | 2 | 8592 |
| 542 | K | F | V | Q | S | C | I | D | W | 2 | 8593 |
| 543 | F | V | Q | S | C | I | D | W | N | 2 | 8594 |
| 545 | Q | S | C | I | D | W | N | R | E | 2 | 8595 |
| 554 | V | L | K | R | E | L | G | L | A | 2 | 8596 |
| 562 | A | E | C | D | I | I | D | I | P | 2 | 8597 |
| 578 | K | K | A | T | A | F | F | P | D | 2 | 8598 |
| 602 | P | F | G | P | I | I | N | G | C | 2 | 8599 |
| 630 | F | I | D | D | F | T | P | Y | H | 2 | 8600 |
| 651 | C | R | K | P | F | S | F | K | W | 2 | 8601 |
| 7 | V | R | V | S | L | E | H | P | T | 1 | 8602 |
| 17 | A | V | C | V | A | G | V | E | T | 1 | 8603 |
| 31 | G | S | V | P | E | G | T | E | M | 1 | 8604 |
| 36 | T | E | M | F | E | V | Y | G | I | 1 | 8605 |
| 48 | V | D | I | Y | I | S | P | N | M | 1 | 8606 |
| 63 | A | D | T | R | R | W | R | F | D | 1 | 8607 |
| 90 | S | H | V | Q | I | S | Y | H | S | 1 | 8608 |
| 91 | H | V | Q | I | S | Y | H | S | S | 1 | 8609 |
| 93 | Q | I | S | Y | H | S | S | H | E | 1 | 8610 |
| 125 | C | E | G | R | Q | D | R | N | F | 1 | 8611 |
| 137 | R | Q | W | V | W | G | P | S | G | 1 | 8612 |
| 138 | Q | W | V | W | G | P | S | G | Y | 1 | 8613 |
| 153 | N | C | D | R | D | D | P | S | C | 1 | 8614 |
| 160 | S | C | D | V | Q | D | N | C | D | 1 | 8615 |
| 161 | C | D | V | Q | D | N | C | D | Q | 1 | 8616 |
| 173 | C | L | Q | D | L | E | D | M | S | 1 | 8617 |
| 181 | S | V | M | V | L | R | T | Q | G | 1 | 8618 |

TABLE XXXIV-continued

| Pos | 1 | 2 | 3 | 4 | 5 | 6 | 7 | 8 | 9 | score | SEQ. ID NO. |
|---|---|---|---|---|---|---|---|---|---|---|---|
| 182 | V | M | V | L | R | T | Q | G | P | 1 | 8619 |
| 211 | A | Q | V | F | H | I | C | G | P | 1 | 8620 |
| 212 | Q | V | F | H | I | C | G | P | E | 1 | 8621 |
| 213 | V | F | H | I | C | G | P | E | D | 1 | 8622 |
| 223 | C | E | A | Y | R | H | V | L | G | 1 | 8623 |
| 238 | E | V | P | R | L | H | G | D | E | 1 | 8624 |
| 275 | S | N | E | D | F | S | A | S | P | 1 | 8625 |
| 277 | E | D | F | S | A | S | P | I | F | 1 | 8626 |
| 333 | K | L | T | I | C | P | Q | A | E | 1 | 8627 |
| 343 | R | N | D | R | W | I | Q | D | E | 1 | 8628 |
| 344 | N | D | R | W | I | Q | D | E | M | 1 | 8629 |
| 347 | W | I | Q | D | E | M | E | L | G | 1 | 8630 |
| 351 | E | M | E | L | G | Y | V | Q | A | 1 | 8631 |
| 365 | P | V | V | F | D | S | P | R | N | 1 | 8632 |
| 380 | P | Y | K | R | I | L | G | P | D | 1 | 8633 |
| 382 | K | R | I | L | G | P | D | F | G | 1 | 8634 |
| 399 | R | S | V | S | G | L | D | S | F | 1 | 8635 |
| 400 | S | V | S | G | L | D | S | F | G | 1 | 8636 |
| 401 | V | S | G | L | D | S | F | G | N | 1 | 8637 |
| 403 | G | L | D | S | F | G | N | L | E | 1 | 8638 |
| 406 | S | F | G | N | L | E | V | S | P | 1 | 8639 |
| 416 | V | V | A | N | G | K | E | Y | P | 1 | 8640 |
| 418 | A | N | G | K | E | Y | P | L | G | 1 | 8641 |
| 443 | T | Q | V | V | R | D | F | L | H | 1 | 8642 |
| 446 | V | R | D | F | L | H | A | Q | K | 1 | 8643 |
| 465 | W | L | A | V | G | H | V | D | E | 1 | 8644 |
| 476 | S | F | V | P | A | P | D | G | K | 1 | 8645 |
| 483 | G | K | G | F | R | M | L | L | A | 1 | 8646 |
| 485 | G | F | R | M | L | L | A | S | P | 1 | 8647 |
| 502 |   |   |   | E K Q K C G H G |   |   |   |   |   |   | 8648 |

TABLE XXXV

184P1E2 v.1: HLA Peptide Scoring Results A1 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 87 | L | N | D | S | H | V | Q | I | S | Y | 29 | 8649 |
| 98 | S | S | H | E | P | L | P | L | A | Y | 27 | 8650 |
| 628 | C | T | F | I | D | D | F | T | P | Y | 24 | 8651 |
| 285 | F | T | D | T | V | V | P | R | V | A | 21 | 8652 |
| 347 | W | I | Q | D | E | M | E | L | G | Y | 21 | 8653 |
| 531 | V | L | S | N | K | D | L | I | N | Y | 21 | 8654 |
| 300 | P | S | T | L | P | P | L | E | V | Y | 20 | 8655 |
| 34 | P | E | G | T | E | M | F | E | V | Y | 19 | 8656 |
| 102 | P | L | P | L | A | Y | A | V | L | Y | 18 | 8657 |
| 194 | F | D | D | H | K | L | V | L | H | T | 18 | 8658 |
| 403 | G | L | D | S | F | G | N | L | E | V | 18 | 8659 |
| 584 | F | P | D | L | V | N | M | L | V | L | 18 | 8660 |
| 613 | L | E | E | K | V | R | S | L | L | E | 18 | 8661 |
| 21 | A | G | V | E | T | L | V | D | I | Y | 17 | 8662 |
| 36 | G | T | E | M | F | E | V | Y | G | T | 17 | 8663 |
| 42 | V | Y | G | T | P | G | V | D | I | Y | 17 | 8664 |
| 319 | F | V | D | A | V | A | E | L | A | R | 17 | 8665 |
| 99 | S | H | E | P | L | P | L | A | Y | A | 16 | 8666 |
| 228 | H | V | L | G | Q | D | K | V | S | Y | 16 | 8667 |
| 393 | T | R | E | P | R | D | R | S | V | S | 16 | 8668 |
| 414 | P | P | V | V | A | N | G | K | E | Y | 16 | 8669 |
| 480 | A | P | D | G | K | G | F | R | M | L | 16 | 8670 |
| 574 | K | T | E | R | K | K | A | T | A | F | 16 | 8671 |
| 137 | R | Q | W | V | W | G | P | S | G | Y | 15 | 8672 |
| 197 | H | K | L | V | L | H | T | S | S | Y | 15 | 8673 |
| 217 | C | G | P | E | D | V | C | E | A | Y | 15 | 8674 |
| 250 | F | V | E | G | L | S | F | P | D | A | 15 | 8675 |
| 372 | R | N | G | E | L | Q | D | F | P | Y | 15 | 8676 |
| 382 | K | R | I | L | G | P | D | F | G | Y | 15 | 8677 |
| 620 | L | E | I | P | L | G | L | H | C | T | 15 | 8678 |
| 10 | S | L | E | H | P | T | S | A | V | C | 14 | 8679 |
| 22 | G | V | E | T | L | V | D | I | Y | G | 14 | 8680 |
| 69 | R | F | D | A | T | L | E | I | I | V | 14 | 8681 |
| 118 | S | L | D | C | D | L | N | C | E | G | 14 | 8682 |

TABLE XXXV-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 156 | R | D | D | P | S | C | D | V | Q | D | 14 | 8683 |
| 243 | H | G | D | E | E | R | F | F | V | E | 14 | 8684 |
| 471 | V | D | E | F | L | S | F | V | P | A | 14 | 8685 |
| 519 | D | D | E | Q | V | K | T | I | S | I | 14 | 8686 |
| 580 | A | T | A | F | F | P | P | D | L | V | 14 | 8687 |
| 612 | C | L | E | E | K | V | R | S | L | L | 14 | 8688 |
| 84 | S | N | D | L | N | D | S | H | V | Q | 13 | 8689 |
| 128 | R | Q | D | R | N | F | V | D | K | R | 13 | 8690 |
| 160 | S | C | D | V | Q | D | N | C | D | Q | 13 | 8691 |
| 176 | D | L | E | D | M | S | V | M | V | L | 13 | 8692 |
| 186 | R | T | Q | G | P | A | A | L | F | D | 13 | 8693 |
| 205 | S | Y | D | A | K | R | A | Q | V | F | 13 | 8694 |
| 222 | V | C | E | A | Y | R | H | V | L | G | 13 | 8695 |
| 244 | G | D | E | E | R | F | F | V | E | G | 13 | 8696 |
| 256 | F | P | D | A | G | F | T | G | L | I | 13 | 8697 |
| 362 | K | T | L | P | V | V | F | D | S | P | 13 | 8698 |
| 373 | N | G | E | L | Q | D | F | P | Y | K | 13 | 8699 |
| 446 | V | R | D | F | L | H | A | Q | K | V | 13 | 8700 |
| 551 | N | R | E | V | L | K | R | E | L | G | 13 | 8701 |
| 33 | V | P | E | G | T | E | M | F | E | V | 12 | 8702 |
| 73 | T | L | E | I | I | V | V | M | N | S | 12 | 8703 |
| 112 | L | T | C | V | D | I | S | L | D | C | 12 | 8704 |
| 143 | P | S | G | Y | G | G | I | L | L | V | 12 | 8705 |
| 163 | V | Q | D | N | C | D | Q | H | V | H | 12 | 8706 |
| 166 | N | C | D | Q | H | V | H | C | L | Q | 12 | 8707 |
| 177 | L | E | D | M | S | V | M | V | L | R | 12 | 8708 |
| 193 | L | F | D | D | H | K | L | V | L | H | 12 | 8709 |
| 235 | V | S | Y | E | V | P | R | L | H | G | 12 | 8710 |
| 236 | S | Y | E | V | P | R | L | H | G | D | 12 | 8711 |
| 275 | S | N | E | D | F | S | A | S | P | I | 12 | 8712 |
| 301 | S | T | L | P | P | L | E | V | Y | V | 12 | 8713 |
| 305 | P | L | E | V | Y | V | C | R | V | R | 12 | 8714 |
| 349 | Q | D | E | M | E | L | G | Y | V | Q | 12 | 8715 |
| 367 | V | F | D | S | P | R | N | G | H | L | 12 | 8716 |
| 396 | P | R | D | R | S | V | S | G | L | D | 12 | 8717 |
| 409 | N | L | E | V | S | P | P | V | V | A | 12 | 8718 |
| 458 | P | V | E | L | F | V | D | W | L | A | 12 | 8719 |
| 462 | F | V | D | W | L | A | V | G | H | V | 12 | 8720 |
| 517 | V | V | D | D | E | Q | V | K | T | I | 12 | 8721 |
| 534 | N | K | D | L | I | N | Y | N | K | F | 12 | 8722 |
| 547 | C | I | D | W | N | R | E | V | L | K | 12 | 8723 |
| 566 | I | I | D | I | P | Q | L | F | K | T | 12 | 8724 |
| 124 | N | C | E | G | R | Q | D | R | N | F | 11 | 8725 |
| 133 | F | V | D | K | R | Q | W | V | W | G | 11 | 8726 |
| 155 | D | R | D | D | P | S | C | D | V | Q | 11 | 8727 |
| 174 | L | Q | D | L | E | D | M | S | V | M | 11 | 8728 |
| 231 | G | Q | D | K | V | S | Y | E | V | P | 11 | 8729 |
| 245 | D | E | E | R | F | F | V | E | G | L | 11 | 8730 |
| 261 | F | T | G | L | I | S | F | H | V | T | 11 | 8731 |
| 271 | L | L | D | D | S | N | E | D | F | S | 11 | 8732 |
| 323 | V | A | E | L | A | R | K | A | G | C | 11 | 8733 |
| 351 | E | M | E | L | G | Y | V | Q | A | L | 11 | 8734 |
| 357 | V | Q | A | P | H | K | T | L | P | V | 11 | 8735 |
| 377 | Q | D | F | P | Y | K | R | I | L | G | 11 | 8736 |
| 386 | P | D | F | G | Y | V | T | R | E | P | 11 | 8737 |
| 420 | G | K | E | Y | P | L | G | R | I | L | 11 | 8738 |
| 421 | K | E | Y | P | L | G | R | I | L | I | 11 | 8739 |
| 470 | H | V | D | E | F | L | S | F | V | P | 11 | 8740 |
| 491 | A | S | P | G | A | C | F | K | L | F | 11 | 8741 |
| 500 | F | Q | E | K | Q | K | C | G | H | G | 11 | 8742 |
| 518 | V | D | D | E | Q | V | K | T | I | S | 11 | 8743 |
| 630 | F | I | D | D | F | T | P | Y | H | M | 11 | 8744 |
| 631 | I | D | D | F | T | P | Y | H | M | L | 11 | 8745 |
| 641 | H | G | E | V | H | C | G | T | N | V | 11 | 8746 |
| 26 | L | V | D | I | Y | G | S | V | P | E | 10 | 8747 |
| 39 | M | F | E | V | Y | G | T | P | G | V | 10 | 8748 |
| 43 | Y | G | T | P | G | V | D | I | Y | I | 10 | 8749 |
| 47 | G | V | D | I | Y | I | S | P | N | M | 10 | 8750 |
| 55 | N | M | E | R | G | R | E | R | A | D | 10 | 8751 |
| 59 | G | R | E | R | A | D | T | R | R | W | 10 | 8752 |
| 62 | R | A | D | T | R | R | W | R | F | D | 10 | 8753 |
| 80 | M | N | S | P | T | R | S | N | D | L | 10 | 8754 |
| 114 | C | V | D | I | S | L | D | C | D | L | 10 | 8755 |
| 120 | D | C | D | L | N | C | E | G | R | Q | 10 | 8756 |
| 144 | S | G | Y | G | G | I | L | L | V | N | 10 | 8757 |
| 153 | N | C | D | R | D | D | P | S | C | D | 10 | 8758 |

TABLE XXXV-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 218 | G | P | E | D | V | D | E | A | Y | R | 10 | 8759 |
| 219 | P | E | D | V | C | E | A | Y | R | H | 10 | 8760 |
| 265 | I | S | F | H | V | T | L | L | D | D | 10 | 8761 |
| 272 | L | D | D | S | N | E | D | F | S | A | 10 | 8762 |
| 276 | N | E | D | F | S | A | S | P | I | F | 10 | 8763 |
| 339 | Q | A | E | N | R | N | D | R | W | I | 10 | 8764 |
| 343 | R | N | D | R | W | I | Q | D | E | M | 10 | 8765 |
| 348 | I | Q | D | E | M | E | L | G | Y | V | 10 | 8766 |
| 369 | D | S | P | R | N | G | E | L | Q | D | 10 | 8767 |
| 376 | L | Q | D | F | P | Y | K | R | I | L | 10 | 8768 |
| 454 | K | V | Q | P | P | V | E | L | F | V | 10 | 8769 |
| 468 | V | G | H | V | D | E | F | L | S | F | 10 | 8770 |
| 556 | K | R | E | L | G | L | A | E | C | D | 10 | 8771 |
| 561 | L | A | E | C | D | I | I | D | I | P | 10 | 8772 |
| 563 | E | C | D | I | I | D | I | P | Q | L | 10 | 8773 |
| 619 | S | L | L | E | P | L | G | L | H | C | 10 | 8774 |
| 633 | D | F | T | P | Y | H | M | L | H | G | 10 | 8775 |
| 31 | G | S | V | P | E | G | T | E | M | F | 9 | 8776 |
| 64 | D | T | R | R | W | R | F | D | A | T | 9 | 8777 |
| 72 | A | T | L | E | I | I | V | V | M | N | 9 | 8778 |
| 192 | A | L | F | D | D | H | K | L | V | L | 9 | 8779 |
| 254 | L | S | F | P | D | A | G | F | T | G | 9 | 8780 |
| 412 | V | S | P | P | V | V | A | N | G | K | 9 | 8781 |
| 442 | V | T | Q | V | V | R | D | F | L | H | 9 | 8782 |
| 443 | T | Q | V | V | R | D | F | L | H | A | 9 | 8783 |
| 482 | D | G | K | G | F | R | M | L | L | A | 9 | 8784 |
| 548 | I | D | W | N | R | E | V | L | K | R | 9 | 8785 |
| 554 | V | L | K | R | E | L | G | L | A | E | 9 | 8786 |
| 19 | C | V | A | G | V | E | T | L | V | D | 8 | 8787 |
| 96 | Y | H | S | S | H | E | P | L | P | L | 8 | 8788 |
| 142 | G | P | S | G | Y | G | G | I | L | L | 8 | 8789 |
| 257 | P | D | A | G | F | T | G | L | I | S | 8 | 8790 |
| 264 | L | I | S | F | H | V | T | L | L | D | 8 | 8791 |
| 279 | F | S | A | S | P | I | F | T | D | T | 8 | 8792 |
| 298 | M | T | P | S | T | L | P | P | L | E | 8 | 8793 |
| 368 | F | D | S | P | R | N | G | E | L | Q | 8 | 8794 |
| 401 | V | S | G | L | D | S | F | G | N | L | 8 | 8795 |
| 476 | S | F | V | P | A | P | D | G | K | G | 8 | 8796 |
| 492 | S | P | G | A | C | F | K | L | F | Q | 8 | 8797 |
| 505 | K | C | G | H | G | R | A | L | L | F | 8 | 8798 |
| 524 | K | T | I | S | I | N | Q | V | L | S | 8 | 8799 |
| 586 | D | L | V | N | M | L | V | L | G | K | 8 | 8800 |
| 599 | I | P | K | P | F | G | P | I | I | N | 8 | 8801 |
| 14 | P | T | S | A | V | C | V | A | G | V | 7 | 8802 |
| 44 | G | T | P | G | V | D | I | Y | I | S | 7 | 8803 |
| 103 | L | P | L | A | Y | A | V | L | Y | L | 7 | 8804 |
| 178 | E | D | M | S | V | M | V | L | R | T | 7 | 8805 |
| 204 | S | S | Y | D | A | K | R | A | Q | V | 7 | 8806 |
| 223 | C | E | A | Y | R | H | V | L | G | Q | 7 | 8807 |
| 247 | E | R | F | F | V | E | G | L | S | P | 7 | 8808 |
| 269 | V | T | L | L | D | D | S | N | E | D | 7 | 8809 |
| 287 | D | T | V | V | F | R | V | A | P | W | 7 | 8810 |
| 302 | T | L | P | P | L | E | V | Y | V | C | 7 | 8811 |
| 327 | A | R | K | A | G | C | K | L | T | I | 7 | 8812 |
| 384 | I | L | G | P | D | F | G | Y | V | T | 7 | 8813 |
| 392 | V | T | R | E | P | R | D | R | S | V | 7 | 8814 |
| 397 | R | D | R | S | V | S | G | L | D | S | 7 | 8815 |
| 418 | A | N | G | K | E | Y | P | L | G | R | 7 | 8816 |
| 423 | Y | P | L | G | R | I | L | I | G | G | 7 | 8817 |
| 427 | R | I | L | I | G | G | N | L | P | G | 7 | 8818 |
| 437 | S | S | G | R | R | V | T | Q | V | V | 7 | 8819 |
| 459 | V | E | L | F | V | D | W | L | A | V | 7 | 8820 |
| 506 | C | G | H | G | R | A | L | L | F | Q | 7 | 8821 |
| 525 | T | I | S | I | N | Q | V | L | S | N | 7 | 8822 |
| 567 | I | D | I | P | Q | L | F | K | T | E | 7 | 8823 |
| 582 | A | F | F | P | D | L | V | N | M | L | 7 | 8824 |
| 590 | M | L | V | L | G | K | H | L | G | I | 7 | 8825 |
| 592 | V | L | G | K | H | L | G | I | P | K | 7 | 8826 |
| 597 | L | G | I | P | K | P | F | G | P | I | 7 | 8827 |
| 606 | I | I | N | G | C | C | C | L | E | E | 7 | 8828 |
| 617 | V | R | S | L | L | E | P | L | G | L | 7 | 8829 |
| 624 | L | G | L | H | C | T | F | I | D | D | 7 | 8830 |
| 634 | F | T | P | Y | H | M | L | H | G | E | 7 | 8831 |
| 651 | C | R | K | P | F | S | F | K | W | W | 7 | 8832 |
| 655 | F | S | F | K | W | W | N | M | V | P | 7 | 8833 |
| 1 | M | S | L | Q | R | I | V | R | V | S | 6 | 8834 |
| 4 | Q | R | I | V | R | V | S | L | E | H | 6 | 8835 |
| 24 | E | T | L | V | D | I | Y | G | S | V | 6 | 8836 |
| 51 | Y | I | S | P | N | M | E | R | G | R | 6 | 8837 |
| 67 | R | W | R | F | D | A | T | L | E | I | 6 | 8838 |
| 70 | F | D | A | T | L | E | I | I | V | V | 6 | 8839 |
| 97 | H | S | S | H | E | P | L | P | L | A | 6 | 8840 |
| 105 | L | A | Y | A | V | L | Y | L | T | C | 6 | 8841 |
| 116 | D | I | S | L | D | C | D | L | N | C | 6 | 8842 |
| 167 | C | D | Q | H | V | H | C | L | Q | D | 6 | 8843 |
| 170 | H | V | H | C | L | Q | D | L | E | D | 6 | 8844 |
| 202 | H | T | S | S | Y | D | A | K | R | A | 6 | 8845 |
| 237 | Y | E | V | P | R | L | H | G | D | E | 6 | 8846 |
| 280 | S | A | D | P | I | F | T | D | T | V | 6 | 8847 |
| 281 | A | S | P | I | F | T | D | T | V | V | 6 | 8848 |
| 290 | V | F | R | V | A | P | W | I | M | T | 6 | 8849 |
| 296 | W | I | M | T | P | S | T | L | P | P | 6 | 8850 |
| 299 | T | P | S | T | L | P | P | L | E | V | 6 | 8851 |
| 316 | N | T | C | F | V | D | A | V | A | E | 6 | 8852 |
| 334 | L | T | I | C | P | Q | A | E | N | R | 6 | 8853 |
| 378 | D | F | P | Y | K | R | I | L | G | P | 6 | 8854 |
| 422 | E | Y | P | L | G | R | I | L | I | G | 6 | 8855 |
| 436 | G | S | S | G | R | R | V | T | Q | V | 6 | 8856 |
| 455 | V | Q | P | P | V | E | L | F | V | D | 6 | 8857 |
| 483 | G | K | G | F | R | M | L | L | A | S | 6 | 8858 |
| 490 | L | A | S | P | G | A | C | F | K | L | 6 | 8859 |
| 530 | Q | V | L | S | N | K | D | L | I | N | 6 | 8860 |
| 552 | R | E | V | L | K | R | E | L | G | L | 6 | 8861 |
| 565 | D | I | I | D | I | P | Q | L | F | K | 6 | 8862 |
| 614 | E | E | K | V | R | S | L | L | E | P | 6 | 8863 |
| 618 | R | S | L | L | E | P | L | G | L | H | 6 | 8864 |
| 647 | G | T | N | V | C | R | K | P | F | S | 6 | 8865 |
| 9 | V | S | L | E | H | P | T | S | A | V | 5 | 8866 |
| 15 | T | S | A | V | C | V | A | G | V | E | 5 | 8867 |
| 52 | I | S | P | N | M | E | R | G | R | E | 5 | 8868 |
| 101 | E | P | L | P | L | A | Y | A | V | L | 5 | 8869 |
| 111 | Y | L | T | C | V | D | I | S | L | D | 5 | 8870 |
| 140 | V | W | G | P | S | G | Y | G | G | I | 5 | 8871 |
| 180 | M | S | V | M | V | L | R | T | Q | G | 5 | 8872 |
| 216 | I | C | G | P | E | D | V | C | E | A | 5 | 8873 |
| 255 | S | F | P | D | A | G | F | T | G | L | 5 | 8874 |
| 402 | S | G | L | D | S | F | G | N | L | E | 5 | 8875 |
| 405 | D | S | F | G | N | L | E | V | S | P | 5 | 8876 |
| 411 | E | V | S | P | P | V | V | A | N | G | 5 | 8877 |
| 413 | S | P | P | V | V | A | N | G | K | E | 5 | 8878 |
| 478 | V | P | A | P | D | G | K | G | F | R | 5 | 8879 |
| 545 | Q | S | C | I | D | W | N | R | E | V | 5 | 8880 |
| 560 | G | L | A | E | C | D | I | I | D | I | 5 | 8881 |
| 562 | A | E | C | D | I | I | D | I | P | Q | 5 | 8882 |
| 602 | P | F | G | P | I | I | N | G | C | C | 5 | 8883 |
| 2 | S | L | Q | R | I | V | R | V | S | I | 4 | 8884 |
| 11 | L | E | H | P | T | S | A | V | C | V | 4 | 8885 |
| 45 | T | P | G | V | D | I | Y | I | S | P | 4 | 8886 |
| 79 | V | M | N | S | P | S | N | D | L | N | 4 | 8887 |
| 81 | N | S | P | S | N | D | L | N | D | S | 4 | 8888 |
| 83 | P | S | N | D | L | N | D | S | H | V | 4 | 8889 |
| 89 | D | S | H | V | Q | I | S | Y | H | S | 4 | 8890 |
| 94 | I | S | Y | H | S | S | H | E | P | L | 4 | 8891 |
| 95 | S | Y | H | S | S | H | E | P | L | P | 4 | 8892 |
| 110 | L | Y | L | T | C | V | D | I | S | L | 4 | 8893 |
| 117 | I | S | L | D | C | D | L | N | C | E | 4 | 8894 |
| 159 | P | S | C | D | V | Q | D | N | C | D | 4 | 8895 |
| 187 | T | Q | G | P | A | A | L | F | D | D | 4 | 8896 |
| 203 | T | S | S | Y | D | A | K | R | A | Q | 4 | 8897 |
| 208 | A | K | R | A | Q | V | F | H | I | C | 4 | 8898 |
| 209 | K | R | A | Q | V | F | H | I | C | G | 4 | 8899 |
| 226 | Y | R | H | V | L | G | Q | D | K | V | 4 | 8900 |
| 258 | D | A | G | F | T | G | L | I | S | F | 4 | 8901 |
| 263 | G | L | I | S | F | H | V | T | L | L | 4 | 8902 |
| 274 | D | S | N | E | D | F | S | A | S | P | 4 | 8903 |
| 277 | E | D | F | S | A | S | P | I | F | T | 4 | 8904 |
| 292 | R | V | A | P | W | I | M | T | P | S | 4 | 8905 |
| 297 | I | M | T | P | S | T | L | P | P | L | 4 | 8906 |
| 313 | V | R | N | N | T | C | F | V | D | A | 4 | 8907 |
| 325 | E | L | A | R | K | A | G | C | K | L | 4 | 8908 |
| 329 | K | A | G | C | K | L | T | I | C | P | 4 | 8909 |
| 335 | T | I | C | P | Q | A | E | N | R | N | 4 | 8910 |

TABLE XXXV-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 341 | E | N | R | N | D | R | W | I | Q | D | 4 | 8911 |
| 356 | Y | V | Q | A | P | H | K | T | L | P | 4 | 8912 |
| 383 | R | I | L | G | P | D | F | G | Y | V | 4 | 8913 |
| 399 | R | S | V | S | G | L | D | S | F | G | 4 | 8914 |
| 417 | V | A | N | G | K | E | Y | P | L | G | 4 | 8915 |
| 432 | G | N | L | P | G | S | S | G | R | R | 4 | 8916 |
| 475 | L | S | F | V | P | A | P | D | G | K | 4 | 8917 |
| 504 | Q | K | C | G | H | G | R | A | L | L | 4 | 8918 |
| 521 | E | Q | V | K | T | I | S | I | N | Q | 4 | 8919 |
| 526 | I | S | I | N | Q | V | L | S | N | K | 4 | 8920 |
| 527 | S | I | N | Q | V | L | S | N | K | D | 4 | 8921 |
| 532 | L | S | N | K | D | L | I | N | Y | N | 4 | 8922 |
| 541 | N | K | F | V | Q | S | C | I | D | W | 4 | 8923 |
| 546 | S | C | I | D | W | N | R | E | V | L | 4 | 8924 |
| 559 | L | G | L | A | E | C | D | I | I | D | 4 | 8925 |
| 571 | Q | L | F | K | T | E | R | K | K | A | 4 | 8926 |
| 583 | F | F | P | D | L | V | N | M | L | V | 4 | 8927 |
| 600 | P | K | P | F | G | P | I | I | N | G | 4 | 8928 |
| 3 | L | Q | R | I | V | R | V | S | L | E | 3 | 8929 |
| 16 | S | A | V | C | V | A | G | V | E | T | 3 | 8930 |
| 18 | V | C | V | A | G | V | E | T | L | V | 3 | 8931 |
| 25 | T | L | V | D | I | Y | G | S | V | P | 3 | 8932 |
| 30 | Y | G | S | V | P | E | G | T | E | M | 3 | 8933 |
| 53 | S | P | N | M | E | R | G | R | E | R | 3 | 8934 |
| 82 | S | P | S | N | D | L | N | D | S | H | 3 | 8935 |
| 104 | P | L | A | Y | A | V | L | Y | L | T | 3 | 8936 |
| 107 | Y | A | V | L | Y | L | T | C | V | D | 3 | 8937 |
| 109 | V | L | Y | L | T | C | V | D | I | S | 3 | 8938 |
| 115 | V | D | I | S | L | D | C | D | L | N | 3 | 8939 |
| 127 | G | R | Q | D | R | N | F | V | D | K | 3 | 8940 |
| 146 | Y | G | G | I | L | L | V | N | C | D | 3 | 8941 |
| 188 | Q | G | P | A | A | L | F | D | D | H | 3 | 8942 |
| 191 | A | A | L | F | D | D | H | K | L | V | 3 | 8943 |
| 229 | V | L | G | Q | D | K | V | S | Y | E | 3 | 8944 |
| 273 | D | D | S | N | E | D | F | S | A | S | 3 | 8945 |
| 282 | S | P | I | F | T | D | T | V | V | F | 3 | 8946 |
| 309 | Y | V | C | R | V | R | N | N | T | C | 3 | 8947 |
| 391 | Y | V | T | R | E | P | R | D | R | S | 3 | 8948 |
| 400 | S | V | S | G | L | D | S | F | G | N | 3 | 8949 |
| 406 | S | F | G | N | L | E | V | S | P | P | 3 | 8950 |
| 426 | G | R | I | L | I | G | G | N | L | P | 3 | 8951 |
| 433 | N | L | P | G | S | S | G | R | R | V | 3 | 8952 |
| 438 | S | G | R | R | V | T | Q | V | V | R | 3 | 8953 |
| 449 | F | L | H | A | Q | K | V | Q | P | P | 3 | 8954 |
| 453 | Q | K | V | Q | P | P | V | E | L | F | 3 | 8955 |
| 456 | Q | P | P | V | E | L | F | V | D | W | 3 | 8956 |
| 463 | V | D | W | L | A | V | G | H | V | D | 3 | 8957 |
| 467 | A | V | G | H | V | D | E | F | L | S | 3 | 8958 |
| 481 | P | D | G | K | G | F | R | M | L | L | 3 | 8959 |
| 494 | G | A | C | F | K | L | F | Q | E | K | 3 | 8960 |
| 495 | A | C | F | K | L | F | Q | E | K | Q | 3 | 8961 |
| 497 | F | K | L | F | Q | E | K | Q | K | C | 3 | 8962 |
| 508 | H | G | R | A | L | L | F | Q | G | V | 3 | 8963 |
| 511 | A | L | L | F | Q | G | V | V | D | D | 3 | 8964 |
| 523 | V | K | T | I | S | I | N | Q | V | L | 3 | 8965 |
| 533 | S | N | K | D | L | I | N | Y | N | K | 3 | 8966 |
| 537 | L | I | N | Y | N | K | F | V | Q | S | 3 | 8967 |
| 577 | R | K | K | A | T | A | F | F | P | D | 3 | 8968 |
| 578 | K | K | A | T | A | F | F | P | D | L | 3 | 8969 |
| 644 | V | H | C | G | T | N | V | C | R | K | 3 | 8970 |
| 649 | N | V | C | R | K | P | F | S | F | K | 3 | 8971 |
| 650 | V | C | R | K | P | F | S | F | K | W | 3 | 8972 |
| 12 | E | H | P | T | S | A | V | C | V | A | 2 | 8973 |
| 17 | A | V | C | V | A | G | V | E | T | L | 2 | 8974 |
| 27 | V | D | I | Y | G | S | V | P | E | G | 2 | 8975 |
| 32 | S | V | P | E | G | T | E | M | F | E | 2 | 8976 |
| 40 | F | E | V | Y | G | T | P | G | V | D | 2 | 8977 |
| 41 | E | V | Y | G | T | P | G | V | D | I | 2 | 8978 |
| 48 | V | D | I | Y | I | S | P | N | M | E | 3 | 8979 |
| 56 | M | E | R | G | R | E | R | A | D | T | 2 | 8980 |
| 63 | A | D | T | R | R | W | R | F | D | A | 2 | 8981 |
| 66 | R | R | W | R | F | D | A | T | L | E | 2 | 8982 |
| 86 | D | L | N | D | S | H | V | Q | I | S | 2 | 8983 |
| 90 | S | H | V | Q | I | S | Y | H | S | S | 2 | 8984 |
| 122 | D | L | N | C | E | G | R | Q | D | R | 2 | 8985 |
| 126 | E | G | R | Q | D | R | N | F | V | D | 2 | 8986 |
| 134 | V | D | K | R | Q | W | V | W | G | P | 2 | 8987 |
| 139 | W | V | W | G | P | S | G | Y | G | G | 2 | 8988 |
| 150 | L | L | V | N | C | D | R | D | D | P | 2 | 8989 |
| 169 | Q | H | V | H | C | L | Q | D | L | E | 2 | 8990 |
| 181 | S | V | M | V | L | R | T | Q | G | P | 2 | 8991 |
| 184 | V | L | R | T | Q | G | P | A | A | L | 2 | 8992 |
| 185 | L | R | T | Q | G | P | A | A | L | F | 2 | 8993 |
| 190 | P | A | L | F | D | D | H | K | L | 2 | 8994 |
| 200 | V | L | H | T | S | S | Y | D | A | K | 2 | 8995 |
| 201 | L | H | T | S | S | Y | D | A | K | R | 2 | 8996 |
| 206 | Y | D | A | K | R | A | Q | V | F | H | 2 | 8997 |
| 214 | F | H | I | C | G | P | E | D | V | C | 2 | 8998 |
| 221 | D | V | C | E | A | Y | R | H | V | L | 2 | 8999 |
| 225 | A | Y | R | H | V | L | G | Q | D | K | 2 | 9000 |
| 234 | K | V | S | Y | E | V | P | R | L | H | 2 | 9001 |
| 241 | R | L | H | G | D | E | E | R | F | F | 2 | 9002 |
| 246 | E | E | R | F | F | V | E | G | L | S | 2 | 9003 |
| 266 | S | F | H | V | T | L | L | D | D | S | 2 | 9004 |
| 270 | T | L | L | D | D | S | N | E | D | F | 2 | 9005 |
| 295 | P | W | I | M | T | P | S | T | L | P | 2 | 9006 |
| 308 | V | Y | V | C | R | V | R | N | N | T | 2 | 9007 |
| 310 | V | C | R | V | R | N | N | T | C | F | 2 | 9008 |
| 318 | C | F | V | D | A | V | A | E | L | A | 2 | 9009 |
| 321 | D | A | V | A | E | L | A | R | K | A | 2 | 9010 |
| 322 | A | V | A | E | L | A | R | K | A | G | 2 | 9011 |
| 326 | L | A | R | K | A | G | C | K | L | T | 2 | 9012 |
| 340 | A | E | N | R | N | D | R | W | I | Q | 2 | 9013 |
| 346 | R | W | I | Q | D | E | M | E | L | G | 2 | 9014 |
| 354 | L | G | Y | V | Q | A | P | H | K | T | 2 | 9015 |
| 359 | A | P | H | K | T | L | P | V | V | F | 2 | 9016 |
| 366 | V | V | F | D | S | P | R | N | G | E | 2 | 9017 |
| 370 | S | P | R | N | G | E | L | Q | D | F | 2 | 9018 |
| 374 | G | E | L | Q | D | F | P | Y | K | R | 2 | 9019 |
| 381 | Y | K | R | I | L | G | P | D | F | G | 2 | 9020 |
| 428 | I | L | I | G | G | N | L | P | G | S | 2 | 9021 |
| 434 | L | P | G | S | S | G | R | R | V | T | 2 | 9022 |
| 460 | E | L | F | V | D | W | L | A | V | G | 2 | 9023 |
| 465 | W | L | A | V | G | H | V | D | E | F | 2 | 9024 |
| 474 | F | L | S | F | V | P | A | P | D | G | 2 | 9025 |
| 477 | F | V | P | A | P | D | G | K | G | F | 2 | 9026 |
| 488 | M | L | L | A | S | P | G | A | C | F | 2 | 9027 |
| 510 | R | A | L | L | F | Q | G | V | V | D | 2 | 9028 |
| 512 | L | L | F | Q | G | V | V | D | D | E | 2 | 9029 |
| 516 | G | V | V | D | D | E | Q | V | K | T | 2 | 9030 |
| 529 | N | Q | V | L | S | N | K | D | L | I | 2 | 9031 |
| 536 | D | L | I | N | Y | N | K | F | V | Q | 2 | 9032 |
| 540 | Y | N | K | F | V | Q | S | C | I | D | 2 | 9033 |
| 553 | E | V | L | K | R | E | L | G | L | A | 2 | 9034 |
| 564 | C | D | I | I | D | I | P | Q | L | F | 2 | 9035 |
| 570 | P | Q | L | F | K | T | E | R | K | K | 2 | 9036 |
| 579 | K | A | T | A | F | F | P | D | L | V | 2 | 9037 |
| 585 | P | D | L | V | N | M | L | V | L | G | 2 | 9038 |
| 587 | L | V | N | M | L | V | L | G | K | H | 2 | 9039 |
| 588 | V | N | M | L | V | L | G | K | H | L | 2 | 9040 |
| 589 | N | M | L | V | L | G | K | H | L | G | 2 | 9041 |
| 593 | L | G | K | H | L | G | I | P | K | P | 2 | 9042 |
| 603 | F | G | P | I | I | N | G | C | C | C | 2 | 9043 |
| 605 | P | I | I | N | G | C | C | C | L | E | 2 | 9044 |
| 608 | N | G | C | C | C | L | E | P | K | V | 2 | 9045 |
| 616 | K | V | R | S | L | L | E | P | L | G | 2 | 9046 |
| 632 | D | D | F | T | P | Y | H | M | L | H | 2 | 9047 |
| 636 | P | Y | H | M | L | H | G | E | V | H | 2 | 9048 |
| 637 | Y | H | M | L | H | G | E | V | H | C | 2 | 9049 |
| 639 | M | L | H | G | E | V | H | C | G | T | 2 | 9050 |
| 645 | H | C | G | T | N | V | C | R | K | P | 2 | 9051 |
| 7 | V | R | V | S | L | E | H | P | T | S | 1 | 9052 |
| 20 | V | A | G | V | E | T | L | V | D | I | 1 | 9053 |
| 23 | V | E | T | L | V | D | I | Y | G | S | 1 | 9054 |
| 28 | D | I | Y | G | S | V | P | E | G | T | 1 | 9055 |
| 38 | E | M | F | E | V | Y | G | T | P | G | 1 | 9056 |
| 49 | D | I | Y | I | S | P | N | M | E | R | 1 | 9057 |
| 54 | P | N | M | E | R | G | R | E | R | A | 1 | 9058 |
| 60 | R | E | R | A | D | T | R | R | W | R | 1 | 9059 |
| 61 | E | R | A | D | T | R | R | W | R | F | 1 | 9060 |
| 71 | D | A | T | L | E | I | I | V | V | M | 1 | 9061 |
| 75 | E | I | I | V | V | M | N | S | P | S | 1 | 9062 |

TABLE XXXV-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 78 | V | V | M | N | S | P | S | N | D | L | 1 | 9063 |
| 92 | V | Q | I | S | Y | H | S | S | H | E | 1 | 9064 |
| 106 | A | Y | A | V | L | Y | L | T | C | V | 1 | 9065 |
| 108 | A | V | L | Y | L | T | C | V | D | I | 1 | 9066 |
| 121 | C | D | L | N | C | E | G | R | Q | D | 1 | 9067 |
| 125 | C | E | G | R | Q | D | R | N | F | V | 1 | 9068 |
| 131 | R | N | F | V | D | K | R | Q | W | V | 1 | 9069 |
| 132 | N | F | V | D | K | R | Q | W | V | W | 1 | 9070 |
| 136 | K | R | Q | W | V | W | G | P | S | G | 1 | 9071 |
| 141 | W | G | P | S | G | Y | G | G | I | L | 1 | 9072 |
| 145 | G | Y | G | G | I | L | L | V | N | C | 1 | 9073 |
| 147 | G | G | I | L | L | V | N | C | D | R | 1 | 9074 |
| 149 | I | L | L | V | N | C | D | R | D | D | 1 | 9075 |
| 152 | V | N | C | D | R | D | D | P | S | C | 1 | 9076 |
| 157 | D | D | P | S | C | D | V | Q | D | N | 1 | 9077 |
| 165 | D | N | C | D | Q | H | V | H | C | L | 1 | 9078 |
| 171 | V | H | C | L | Q | D | L | E | D | M | 1 | 9079 |
| 172 | H | C | L | Q | D | L | E | D | M | S | 1 | 9080 |
| 173 | C | L | Q | D | L | E | D | M | S | V | 1 | 9081 |
| 175 | Q | D | L | E | D | M | S | V | M | V | 1 | 9082 |
| 182 | V | M | V | L | R | T | Q | G | P | A | 1 | 9083 |
| 183 | M | V | L | R | T | Q | G | P | A | A | 1 | 9084 |
| 198 | K | L | V | L | H | T | S | S | Y | D | 1 | 9085 |
| 207 | D | A | K | R | A | Q | V | F | H | I | 1 | 9086 |
| 211 | A | Q | V | F | H | I | C | G | P | E | 1 | 9087 |
| 212 | Q | V | F | H | I | C | G | P | E | D | 1 | 9088 |
| 213 | V | F | H | I | C | G | P | E | D | V | 1 | 9089 |
| 215 | H | I | C | G | P | E | D | V | C | E | 1 | 9090 |
| 227 | R | H | V | L | G | Q | D | K | V | S | 1 | 9091 |
| 233 | D | K | V | S | Y | E | V | P | R | L | 1 | 9092 |
| 238 | E | V | P | R | L | H | G | D | E | E | 1 | 9093 |
| 239 | V | P | R | L | H | G | D | E | E | R | 1 | 9094 |
| 242 | L | H | G | D | E | E | R | F | F | V | 1 | 9095 |
| 249 | F | F | V | E | G | L | S | F | P | D | 1 | 9096 |
| 251 | V | E | G | L | S | F | P | D | A | G | 1 | 9097 |
| 253 | G | L | S | F | P | D | A | G | F | T | 1 | 9098 |
| 259 | A | G | F | T | G | L | I | S | F | H | 1 | 9099 |
| 260 | G | F | T | G | L | I | S | F | H | V | 1 | 9100 |
| 267 | F | H | V | T | L | L | D | D | S | N | 1 | 9101 |
| 283 | P | I | F | T | D | T | V | V | F | R | 1 | 9102 |
| 284 | I | F | T | D | T | V | V | F | R | V | 1 | 9103 |
| 286 | T | D | T | V | V | F | R | V | A | P | 1 | 9104 |
| 289 | V | V | F | R | V | A | P | W | I | M | 1 | 9105 |
| 291 | F | R | V | A | P | W | I | M | T | P | 1 | 9106 |
| 293 | V | A | P | W | I | M | T | P | S | T | 1 | 9107 |
| 294 | A | P | W | I | M | T | P | S | T | L | 1 | 9108 |
| 304 | P | P | L | E | V | Y | V | C | R | V | 1 | 9109 |
| 306 | L | E | V | Y | V | C | R | V | R | N | 1 | 9110 |
| 307 | E | V | Y | V | C | R | V | R | N | N | 1 | 9111 |
| 312 | R | V | R | N | N | T | C | F | V | D | 1 | 9112 |
| 314 | R | N | N | T | C | F | V | D | A | V | 1 | 9113 |
| 315 | N | N | T | C | F | V | D | A | V | A | 1 | 9114 |
| 317 | T | C | F | V | D | A | V | A | E | L | 1 | 9115 |
| 320 | V | D | A | V | A | E | L | A | R | K | 1 | 9116 |
| 324 | A | E | L | A | R | K | A | G | C | K | 1 | 9117 |
| 328 | R | K | A | G | C | K | L | T | I | C | 1 | 9118 |
| 330 | A | G | C | K | L | T | I | C | P | Q | 1 | 9119 |
| 333 | K | L | T | I | C | P | Q | A | E | N | 1 | 9120 |
| 336 | I | C | P | Q | A | E | N | R | N | D | 1 | 9121 |
| 337 | C | P | Q | A | E | N | R | N | D | R | 1 | 9122 |
| 338 | P | Q | A | E | N | R | N | D | R | W | 1 | 9123 |
| 344 | N | D | R | W | I | Q | D | E | M | E | 1 | 9124 |
| 352 | M | E | L | G | Y | V | Q | A | P | H | 1 | 9125 |
| 353 | E | L | G | Y | V | Q | A | P | H | K | 1 | 9126 |
| 358 | Q | A | P | H | K | T | L | P | V | V | 1 | 9127 |
| 360 | P | H | K | T | L | P | V | V | F | D | 1 | 9128 |
| 361 | H | K | T | L | P | V | V | F | D | S | 1 | 9129 |
| 363 | T | L | P | V | V | F | D | S | P | R | 1 | 9130 |
| 371 | P | R | N | G | E | L | Q | D | F | P | 1 | 9131 |
| 375 | E | L | Q | D | F | P | Y | K | R | I | 1 | 9132 |
| 379 | F | P | Y | K | R | I | L | G | P | D | 1 | 9133 |
| 380 | P | Y | K | R | I | L | G | P | D | F | 1 | 9134 |
| 387 | P | D | F | G | Y | V | T | R | E | P | 1 | 9135 |
| 388 | D | F | G | Y | V | T | R | E | P | R | 1 | 9136 |
| 389 | F | G | Y | V | T | R | E | P | R | D | 1 | 9137 |
| 395 | E | P | R | D | R | S | V | S | G | L | 1 | 9138 |
| 404 | L | D | S | F | G | N | L | E | V | S | 1 | 9139 |
| 407 | F | G | N | L | E | V | S | P | P | V | 1 | 9140 |
| 408 | G | N | L | E | V | S | P | P | V | V | 1 | 9141 |
| 410 | L | E | V | S | P | P | V | V | A | N | 1 | 9142 |
| 416 | V | V | A | N | G | K | E | Y | P | L | 1 | 9143 |
| 424 | P | L | G | R | I | L | I | G | G | N | 1 | 9144 |
| 425 | L | G | R | I | L | I | G | G | N | L | 1 | 9145 |
| 429 | L | I | G | G | N | L | P | G | S | S | 1 | 9146 |
| 430 | I | G | G | N | L | P | G | S | S | G | 1 | 9147 |
| 435 | P | G | S | S | G | R | R | V | T | Q | 1 | 9148 |
| 439 | G | R | R | V | T | Q | V | V | R | D | 1 | 9149 |
| 440 | R | R | V | T | Q | V | V | R | D | F | 1 | 9150 |
| 441 | R | V | T | Q | V | V | R | D | F | L | 1 | 9151 |
| 445 | V | V | R | D | F | L | H | A | Q | K | 1 | 9152 |
| 447 | R | D | F | L | H | A | Q | K | V | Q | 1 | 9153 |
| 451 | H | A | Q | K | V | Q | P | P | V | E | 1 | 9154 |
| 452 | A | Q | K | V | Q | P | P | V | E | L | 1 | 9155 |
| 457 | P | P | V | E | L | F | V | D | W | L | 1 | 9156 |
| 466 | L | A | V | G | H | V | D | E | F | L | 1 | 9157 |
| 472 | D | E | F | L | S | F | V | P | A | P | 1 | 9158 |
| 479 | P | A | P | D | G | K | G | F | R | M | 1 | 9159 |
| 486 | F | R | M | L | L | A | S | P | G | A | 1 | 9160 |
| 489 | L | L | A | S | P | G | A | C | F | K | 1 | 9161 |
| 498 | K | L | F | Q | E | K | Q | K | C | G | 1 | 9162 |
| 501 | Q | E | K | Q | K | C | G | H | G | R | 1 | 9163 |
| 503 | K | Q | K | C | G | H | G | R | A | L | 1 | 9164 |
| 509 | G | R | A | L | F | Q | G | V | V | V | 1 | 9165 |
| 513 | L | F | Q | G | V | V | D | D | E | Q | 1 | 9166 |
| 514 | F | Q | G | V | V | D | D | E | Q | V | 1 | 9167 |
| 515 | Q | G | V | V | D | D | E | Q | V | K | 1 | 9168 |
| 528 | I | N | Q | V | L | S | N | K | D | L | 1 | 9169 |
| 535 | K | D | L | I | N | Y | N | K | F | V | 1 | 9170 |
| 538 | I | N | Y | N | K | F | V | Q | S | C | 1 | 9171 |
| 543 | F | V | Q | S | C | I | D | W | N | R | 1 | 9172 |
| 544 | V | Q | S | C | I | D | W | N | R | E | 1 | 9173 |
| 557 | R | E | L | G | L | A | E | C | D | I | 1 | 9174 |
| 558 | E | L | G | L | A | E | C | D | I | I | 1 | 9175 |
| 573 | F | K | T | E | R | K | K | A | T | A | 1 | 9176 |
| 591 | L | V | L | G | K | H | L | G | I | P | 1 | 9177 |
| 595 | K | H | L | G | I | P | K | P | F | G | 1 | 9178 |
| 596 | H | L | G | I | P | K | P | F | G | P | 1 | 9179 |
| 598 | G | I | P | K | P | F | G | P | I | I | 1 | 9180 |
| 601 | K | P | F | G | P | I | I | N | G | C | 1 | 9181 |
| 609 | G | C | C | C | L | E | E | K | V | R | 1 | 9182 |
| 611 | C | C | L | E | E | K | V | R | S | L | 1 | 9183 |
| 622 | E | P | L | G | L | H | C | T | F | I | 1 | 9184 |
| 623 | P | L | G | L | H | C | T | F | I | D | 1 | 9185 |
| 625 | G | L | H | C | T | F | I | D | D | F | 1 | 9186 |
| 638 | H | M | L | H | G | E | V | H | C | G | 1 | 9187 |
| 642 | G | E | V | H | C | G | T | N | V | C | 1 | 9188 |
| 643 | E | V | H | C | G | T | N | V | C | R | 1 | 9189 |
| 646 | C | G | T | N | V | C | R | K | P | F | 1 | 9190 |
| 654 | P | F | S | F | K | W | W | N | M | V | 1 | 9191 |

184P1E2 v.2: HLA Peptide Scoring Results A1 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 6 | P | S | T | L | A | P | L | E | V | Y | 20 | 9192 |
| 4 | M | T | P | S | T | L | A | P | L | E | 3 | 9193 |
| 7 | S | T | L | A | P | L | E | V | Y | Y | 8 | 9194 |
| 8 | T | L | A | P | L | E | V | Y | Y | C | 7 | 9195 |
| 2 | W | I | M | T | P | S | T | L | A | P | 6 | 9196 |
| 5 | T | P | S | T | L | A | P | L | E | V | 6 | 9197 |
| 3 | I | M | T | P | S | T | L | A | P | L | 4 | 9198 |
| 1 | P | W | I | M | T | P | S | T | L | A | 2 | 9199 |
| 10 | A | P | L | E | V | Y | Y | C | R | V | 2 | 9200 |

184P1E2 v.3: HLA Peptide Scoring Results A1 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 10 | V | P | D | G | K | G | F | R | M | L | 16 | 9201 |
| 1 | V | D | E | F | L | S | F | V | P | V | 14 | 9202 |
| 6 | S | F | V | P | V | P | D | G | K | G | 8 | 9203 |
| 8 | V | P | V | P | D | G | K | G | F | R | 5 | 9204 |
| 5 | L | S | F | V | P | V | P | D | G | K | 4 | 9205 |
| 4 | F | L | S | F | V | P | V | P | D | G | 3 | 9206 |
| 2 | D | E | F | L | S | F | V | P | V | P | 2 | 9207 |

TABLE XXXV-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 7 | F | V | P | V | P | D | G | K | G | F | 2 | 9208 |
| 9 | P | V | P | D | G | K | G | F | R | M | 1 | 9209 |

TABLE XXXVI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| | | | | 184P1E2 v.1: HLA Peptide Scoring Results A0201 10-mers SYFPEITHI | | | | | | | |
| 263 | G | L | I | S | F | H | V | T | L | L | 27 | 9210 |
| 560 | G | L | A | E | C | D | I | I | D | I | 27 | 9211 |
| 2 | S | L | Q | R | I | R | V | S | L | A | 26 | 9212 |
| 297 | I | M | T | P | S | T | L | P | P | L | 26 | 9213 |
| 192 | A | L | F | D | D | H | K | L | V | L | 25 | 9214 |
| 184 | V | L | R | T | Q | G | P | A | A | L | 24 | 9215 |
| 403 | G | L | D | S | F | G | N | L | E | V | 24 | 9216 |
| 173 | C | L | Q | D | L | E | D | M | S | V | 23 | 9217 |
| 176 | D | L | E | D | M | S | V | M | V | L | 23 | 9218 |
| 17 | A | V | C | V | A | G | V | E | T | L | 22 | 9219 |
| 301 | S | T | L | P | P | L | E | V | Y | V | 22 | 9220 |
| 383 | R | I | L | G | P | D | F | G | Y | V | 22 | 9221 |
| 428 | I | L | I | G | G | N | L | P | G | S | 22 | 9222 |
| 433 | N | L | P | G | S | S | G | R | R | V | 22 | 9223 |
| 620 | L | L | E | P | L | G | L | H | C | T | 22 | 9224 |
| 325 | E | L | A | R | K | A | G | C | K | L | 21 | 9225 |
| 612 | C | L | E | E | K | V | R | S | L | L | 21 | 9226 |
| 280 | S | A | S | P | I | F | T | D | T | V | 20 | 9227 |
| 490 | L | A | S | P | G | A | C | F | K | L | 20 | 9228 |
| 566 | I | I | D | I | P | Q | L | F | K | T | 20 | 9229 |
| 582 | A | F | F | P | D | L | V | N | M | L | 20 | 9230 |
| 590 | M | L | V | L | G | K | H | L | G | I | 20 | 9231 |
| 611 | C | C | L | E | E | K | V | R | S | L | 20 | 9232 |
| 20 | V | A | G | V | E | T | L | V | D | I | 19 | 9233 |
| 103 | L | P | L | A | Y | A | V | L | Y | L | 19 | 9234 |
| 317 | T | C | F | V | D | A | V | A | E | L | 19 | 9235 |
| 358 | Q | A | P | H | K | T | L | P | V | V | 19 | 9236 |
| 384 | I | L | G | P | D | F | G | Y | V | T | 19 | 9237 |
| 392 | V | T | R | E | P | R | D | R | S | V | 19 | 9238 |
| 462 | F | V | D | W | L | A | V | G | H | V | 19 | 9239 |
| 511 | A | L | L | F | Q | G | V | V | D | D | 19 | 9240 |
| 517 | V | V | D | D | E | Q | V | K | T | I | 19 | 9241 |
| 14 | P | T | S | A | V | C | V | A | G | V | 18 | 9242 |
| 106 | A | Y | A | V | L | Y | L | T | C | V | 18 | 9243 |
| 348 | I | Q | D | E | M | E | L | G | Y | V | 18 | 9244 |
| 416 | V | V | A | N | G | K | E | Y | P | L | 18 | 9245 |
| 454 | K | V | Q | P | P | V | E | L | F | V | 18 | 9246 |
| 465 | W | L | A | V | G | H | V | D | E | F | 18 | 9247 |
| 466 | L | A | V | G | H | V | D | E | F | L | 18 | 9248 |
| 522 | Q | V | K | T | I | S | I | N | Q | V | 18 | 9249 |
| 598 | G | I | P | K | P | F | G | P | I | I | 18 | 9250 |
| 70 | F | D | A | T | L | E | I | I | V | V | 17 | 9251 |
| 78 | V | V | M | N | S | P | S | N | D | L | 17 | 9252 |
| 104 | P | L | A | Y | A | V | L | Y | L | T | 17 | 9253 |
| 108 | A | V | L | Y | L | T | C | V | D | I | 17 | 9254 |
| 302 | T | L | P | P | L | E | V | Y | V | C | 17 | 9255 |
| 436 | G | S | S | G | R | R | V | T | Q | V | 17 | 9256 |
| 512 | L | L | F | Q | G | V | V | D | D | E | 17 | 9257 |
| 619 | S | L | L | E | P | L | G | L | H | C | 17 | 9258 |
| 639 | M | L | H | G | E | V | H | C | G | T | 17 | 9259 |
| 9 | V | S | L | E | H | P | T | S | A | V | 16 | 9260 |
| 11 | L | E | H | P | T | S | A | V | C | V | 16 | 9261 |
| 72 | A | T | L | E | I | I | V | V | M | N | 16 | 9262 |
| 109 | V | L | Y | L | T | C | V | D | I | A | 16 | 9263 |
| 110 | L | Y | L | T | C | V | D | I | S | L | 16 | 9264 |
| 175 | Q | D | L | E | D | M | S | V | M | V | 16 | 9265 |
| 190 | P | A | A | L | F | D | D | H | K | L | 16 | 9266 |
| 191 | A | A | L | F | D | D | H | K | L | V | 16 | 9267 |
| 204 | S | S | Y | D | A | K | R | A | Q | V | 16 | 9268 |
| 221 | D | V | C | E | A | Y | R | H | V | L | 16 | 9269 |
| 230 | L | G | Q | D | K | V | S | Y | E | V | 16 | 9270 |
| 262 | T | G | L | I | S | F | H | V | T | L | 16 | 9271 |

TABLE XXXVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 281 | I | F | T | D | T | V | V | F | R | V | 16 | 9272 |
| 314 | R | N | N | T | C | F | V | D | A | V | 16 | 9273 |
| 357 | V | Q | A | P | H | K | T | L | P | V | 16 | 9274 |
| 408 | G | N | L | E | V | S | P | P | V | V | 16 | 9275 |
| 469 | G | H | V | D | E | F | L | S | F | V | 16 | 9276 |
| 571 | Q | L | F | K | T | E | R | K | K | A | 16 | 9277 |
| 606 | I | I | N | G | C | C | C | L | E | E | 16 | 9278 |
| 24 | E | T | L | V | D | I | Y | G | S | V | 15 | 9279 |
| 28 | D | I | Y | G | S | V | P | E | G | T | 15 | 9280 |
| 86 | D | L | N | D | S | H | V | Q | I | S | 15 | 9281 |
| 111 | Y | L | T | C | V | D | I | S | L | D | 15 | 9282 |
| 165 | D | N | C | D | Q | H | V | H | C | L | 15 | 9283 |
| 229 | V | L | G | Q | D | K | V | S | Y | E | 15 | 9284 |
| 294 | A | P | W | I | M | T | P | S | T | L | 15 | 9285 |
| 304 | P | P | L | E | V | Y | V | C | R | V | 15 | 9286 |
| 375 | E | L | Q | D | F | P | Y | K | R | I | 15 | 9287 |
| 409 | N | L | E | V | S | P | P | V | V | A | 15 | 9288 |
| 449 | F | L | H | A | Q | K | V | Q | P | P | 15 | 9289 |
| 450 | L | H | A | Q | K | V | Q | P | P | V | 15 | 9290 |
| 452 | A | Q | K | V | Q | P | P | V | E | L | 15 | 9291 |
| 525 | T | I | S | I | N | Q | V | L | S | N | 15 | 9292 |
| 531 | V | L | S | N | K | D | L | I | N | Y | 15 | 9293 |
| 546 | S | C | I | D | W | N | R | E | V | L | 15 | 9294 |
| 558 | E | L | G | L | A | E | C | D | I | I | 15 | 9295 |
| 586 | D | L | V | N | M | L | V | L | G | K | 15 | 9296 |
| 625 | G | L | H | C | T | F | I | D | D | F | 15 | 9297 |
| 630 | F | I | D | D | F | T | P | Y | H | M | 15 | 9298 |
| 638 | H | M | L | H | G | E | V | H | C | G | 15 | 9299 |
| 16 | S | A | V | C | V | A | G | V | E | T | 14 | 9300 |
| 33 | V | P | E | G | T | E | M | F | E | V | 14 | 9301 |
| 36 | G | T | E | M | F | E | V | Y | G | T | 14 | 9302 |
| 41 | E | V | Y | G | T | P | G | V | D | I | 14 | 9303 |
| 65 | T | R | R | W | R | F | D | A | T | L | 14 | 9304 |
| 68 | W | R | F | D | A | T | L | E | I | I | 14 | 9305 |
| 114 | C | V | D | I | S | L | D | C | D | L | 14 | 9306 |
| 118 | S | L | D | C | D | L | N | C | E | G | 14 | 9307 |
| 149 | I | L | L | V | N | C | D | R | D | D | 14 | 9308 |
| 162 | D | A | Q | D | N | C | D | Q | H | V | 14 | 9309 |
| 207 | D | A | K | R | A | W | V | F | H | I | 14 | 9310 |
| 216 | I | C | G | P | E | D | V | C | E | A | 14 | 9311 |
| 226 | Y | R | H | V | L | G | Q | D | K | V | 14 | 9312 |
| 233 | D | K | V | S | Y | E | V | P | R | L | 14 | 9313 |
| 253 | G | L | S | F | P | D | A | G | F | T | 14 | 9314 |
| 255 | S | F | P | D | A | G | F | T | G | L | 14 | 9315 |
| 333 | K | L | T | I | C | P | Q | A | E | N | 14 | 9316 |
| 429 | L | I | G | G | N | L | P | G | S | S | 14 | 9317 |
| 459 | V | E | L | F | V | D | W | L | A | V | 14 | 9318 |
| 460 | E | L | F | V | D | W | L | A | V | G | 14 | 9319 |
| 480 | A | P | D | G | K | G | F | R | M | L | 14 | 9320 |
| 488 | M | L | L | A | S | P | G | A | C | F | 14 | 9321 |
| 489 | L | L | A | S | P | G | A | C | F | K | 14 | 9322 |
| 504 | Q | K | C | G | H | G | R | A | L | L | 14 | 9323 |
| 516 | G | V | V | D | D | E | Q | V | K | T | 14 | 9324 |
| 527 | S | I | N | Q | V | L | S | N | K | D | 14 | 9325 |
| 550 | W | N | R | E | V | L | K | R | E | L | 14 | 9326 |
| 578 | K | K | A | T | A | F | F | P | D | L | 14 | 9327 |
| 579 | K | A | T | A | F | F | P | D | L | V | 14 | 9328 |
| 581 | T | A | F | F | P | D | L | V | N | M | 14 | 9329 |
| 591 | L | V | L | G | K | H | L | G | I | P | 14 | 9330 |
| 597 | L | G | I | P | K | P | F | G | P | I | 14 | 9331 |
| 10 | S | L | E | H | P | T | S | A | V | C | 13 | 9332 |
| 51 | Y | I | S | P | N | M | E | R | G | R | 13 | 9333 |
| 73 | T | L | E | I | I | V | V | M | N | S | 13 | 9334 |
| 76 | I | I | V | V | M | N | S | P | S | N | 13 | 9335 |
| 94 | I | S | Y | H | S | S | H | E | P | L | 13 | 9336 |
| 96 | Y | H | S | S | H | E | P | L | P | L | 13 | 9337 |
| 99 | S | H | E | P | L | P | L | A | Y | A | 13 | 9338 |
| 101 | E | P | L | P | L | A | Y | A | V | L | 13 | 9339 |
| 142 | G | P | S | G | Y | G | G | I | L | L | 13 | 9340 |
| 168 | D | Q | H | V | H | C | L | Q | D | L | 13 | 9341 |
| 179 | D | M | S | V | M | V | L | R | T | Q | 13 | 9342 |
| 182 | V | M | V | L | R | T | Q | G | P | A | 13 | 9343 |
| 199 | L | V | L | H | T | S | S | Y | D | A | 13 | 9344 |
| 242 | L | H | G | D | E | E | R | F | F | V | 13 | 9345 |
| 245 | D | E | E | R | F | F | V | E | G | L | 13 | 9346 |
| 270 | T | L | L | D | D | S | N | E | D | F | 13 | 9347 |

TABLE XXXVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 271 | L | L | D | D | S | N | E | D | F | S | 13 | 9348 |
| 299 | T | P | S | T | L | P | P | L | E | V | 13 | 9349 |
| 367 | V | F | D | S | P | R | N | G | E | L | 13 | 9350 |
| 395 | E | P | R | D | R | S | V | S | G | L | 13 | 9351 |
| 407 | F | G | N | L | E | V | S | P | P | V | 13 | 9352 |
| 419 | N | G | K | E | Y | P | L | G | R | I | 13 | 9353 |
| 441 | R | V | T | Q | V | V | R | D | F | L | 13 | 9354 |
| 457 | P | P | V | E | L | F | V | D | W | L | 13 | 9355 |
| 509 | G | R | A | L | L | F | Q | G | V | V | 13 | 9356 |
| 587 | L | V | N | M | L | V | L | G | K | H | 13 | 9357 |
| 604 | G | P | I | I | N | G | C | C | C | L | 13 | 9358 |
| 617 | V | R | S | L | L | E | P | L | G | L | 13 | 9359 |
| 635 | T | P | Y | H | M | L | H | G | E | V | 13 | 9360 |
| 5 | R | I | V | R | V | S | L | E | H | P | 12 | 9361 |
| 44 | G | T | P | G | V | D | I | Y | I | S | 12 | 9362 |
| 71 | D | A | T | L | E | I | I | V | V | M | 12 | 9363 |
| 85 | N | D | L | N | D | S | H | V | Q | I | 12 | 9364 |
| 100 | H | E | P | L | P | L | A | Y | A | V | 12 | 9365 |
| 140 | V | W | G | P | S | G | Y | G | G | I | 12 | 9366 |
| 150 | L | L | V | N | C | D | R | D | D | P | 12 | 9367 |
| 183 | M | V | L | R | T | Q | G | P | A | A | 12 | 9368 |
| 200 | V | L | H | T | S | S | Y | D | A | K | 12 | 9369 |
| 215 | H | I | C | G | P | E | D | V | C | E | 12 | 9370 |
| 228 | H | V | L | G | Q | D | K | V | S | Y | 12 | 9371 |
| 241 | R | L | H | G | D | E | E | R | F | F | 12 | 9372 |
| 260 | G | F | T | G | L | I | S | F | H | V | 12 | 9373 |
| 281 | A | S | P | I | F | T | D | T | V | V | 12 | 9374 |
| 283 | P | I | F | T | D | T | V | V | F | R | 12 | 9375 |
| 288 | T | V | V | F | R | V | A | P | W | I | 12 | 9376 |
| 293 | V | A | P | W | I | M | T | P | S | T | 12 | 9377 |
| 327 | A | R | K | A | G | C | K | L | T | I | 12 | 9378 |
| 345 | D | R | W | I | Q | D | E | M | E | L | 12 | 9379 |
| 355 | G | Y | V | Q | A | P | H | K | T | L | 12 | 9380 |
| 421 | K | E | Y | P | L | G | R | I | L | I | 12 | 9381 |
| 424 | P | L | G | R | I | L | I | G | G | N | 12 | 9382 |
| 425 | L | G | R | I | L | I | G | G | N | L | 12 | 9383 |
| 437 | S | S | G | R | R | V | T | Q | V | V | 12 | 9384 |
| 446 | V | R | D | F | L | H | A | Q | K | V | 12 | 9385 |
| 535 | K | D | L | I | N | Y | N | K | F | V | 12 | 9386 |
| 537 | L | I | N | Y | N | K | F | V | Q | S | 12 | 9387 |
| 545 | Q | S | C | I | D | W | N | R | E | V | 12 | 9388 |
| 552 | R | E | V | L | K | R | E | L | G | L | 12 | 9389 |
| 554 | V | L | K | R | E | L | G | L | A | E | 12 | 9390 |
| 555 | L | K | R | E | L | G | L | A | E | C | 12 | 9391 |
| 557 | R | E | L | G | L | A | E | C | D | I | 12 | 9392 |
| 563 | E | C | D | I | I | D | I | P | Q | L | 12 | 9393 |
| 583 | F | F | P | D | L | V | N | M | L | V | 12 | 9394 |
| 584 | F | P | D | L | V | N | M | L | V | L | 12 | 9395 |
| 608 | N | G | C | C | C | L | E | E | K | V | 12 | 9396 |
| 631 | I | D | D | F | T | P | Y | H | M | L | 12 | 9397 |
| 6 | I | V | R | V | S | L | E | H | P | T | 11 | 9398 |
| 18 | V | C | V | A | G | V | E | T | L | V | 11 | 9399 |
| 25 | T | L | V | D | I | Y | G | S | V | P | 11 | 9400 |
| 39 | M | F | E | V | Y | G | T | P | G | V | 11 | 9401 |
| 43 | Y | G | T | P | G | V | D | I | Y | I | 11 | 9402 |
| 125 | C | E | G | R | Q | D | R | N | F | V | 11 | 9403 |
| 131 | R | N | F | V | D | K | R | Q | W | V | 11 | 9404 |
| 143 | P | S | G | Y | G | G | I | L | L | V | 11 | 9405 |
| 148 | G | I | L | L | V | N | C | D | R | D | 11 | 9406 |
| 154 | C | D | R | D | D | P | S | C | D | V | 11 | 9407 |
| 198 | K | L | V | L | H | T | S | S | Y | D | 11 | 9408 |
| 213 | V | F | H | I | C | G | P | E | D | V | 11 | 9409 |
| 250 | F | V | E | G | L | S | F | P | D | A | 11 | 9410 |
| 335 | T | I | C | P | Q | A | E | N | R | N | 11 | 9411 |
| 339 | Q | A | E | N | R | N | D | R | W | I | 11 | 9412 |
| 347 | W | I | Q | D | E | M | E | L | G | Y | 11 | 9413 |
| 362 | K | T | L | P | V | V | F | D | S | P | 11 | 9414 |
| 376 | L | Q | D | F | P | Y | K | R | I | L | 11 | 9415 |
| 401 | V | S | G | L | D | S | F | G | N | L | 11 | 9416 |
| 423 | Y | P | L | G | R | I | L | I | G | G | 11 | 9417 |
| 427 | R | I | L | I | G | G | N | L | P | G | 11 | 9418 |
| 474 | F | L | S | F | V | P | N | A | P | D | 11 | 9419 |
| 487 | R | M | L | L | A | S | P | G | A | C | 11 | 9420 |
| 498 | K | L | F | Q | E | K | Q | K | C | G | 11 | 9421 |
| 503 | K | Q | K | C | G | H | G | R | A | L | 11 | 9422 |
| 508 | H | G | R | A | L | L | F | Q | G | V | 11 | 9423 |
| 514 | F | Q | G | V | V | D | D | E | Q | V | 11 | 9424 |
| 528 | I | N | Q | V | L | S | N | K | D | L | 11 | 9425 |
| 536 | D | L | I | N | Y | N | K | F | V | Q | 11 | 9426 |
| 553 | E | V | L | K | R | E | L | G | L | A | 11 | 9427 |
| 565 | D | I | I | D | I | P | Q | L | F | K | 11 | 9428 |
| 588 | V | N | M | L | V | L | G | K | H | L | 11 | 9429 |
| 589 | N | M | L | V | L | G | K | H | L | G | 11 | 9430 |
| 592 | V | L | G | K | H | L | G | I | P | K | 11 | 9431 |
| 596 | H | L | G | I | P | K | P | F | G | P | 11 | 9432 |
| 615 | E | K | V | R | S | L | L | E | P | L | 11 | 9433 |
| 8 | R | V | S | L | E | H | P | T | S | A | 10 | 9434 |
| 47 | G | V | D | I | Y | I | S | P | N | M | 10 | 9435 |
| 49 | D | I | Y | I | S | P | N | M | E | R | 10 | 9436 |
| 67 | R | W | R | F | D | A | T | L | E | I | 10 | 9437 |
| 69 | R | F | D | A | T | L | E | I | I | V | 10 | 9438 |
| 79 | V | M | N | S | P | S | N | D | L | N | 10 | 9439 |
| 93 | I | S | Y | H | S | S | H | E | P | Y | 10 | 9440 |
| 105 | L | A | Y | A | V | L | Y | L | T | C | 10 | 9441 |
| 117 | I | S | L | D | C | D | L | N | C | E | 10 | 9442 |
| 122 | D | L | N | C | E | G | R | Q | D | R | 10 | 9443 |
| 141 | W | G | P | S | G | Y | G | G | I | L | 10 | 9444 |
| 144 | S | G | Y | G | G | I | L | L | V | N | 10 | 9445 |
| 194 | F | D | D | H | K | L | V | L | H | T | 10 | 9446 |
| 261 | F | T | G | L | I | S | F | H | V | T | 10 | 9447 |
| 264 | L | I | S | F | H | V | T | L | L | D | 10 | 9448 |
| 269 | V | T | L | L | D | D | S | N | E | D | 10 | 9449 |
| 275 | S | N | E | D | F | S | A | D | P | I | 10 | 9450 |
| 289 | V | V | F | R | V | A | P | W | I | M | 10 | 9451 |
| 296 | W | I | M | T | P | S | T | L | P | P | 10 | 9452 |
| 311 | C | R | V | R | N | N | T | C | F | V | 10 | 9453 |
| 322 | A | V | A | E | L | A | R | K | A | G | 10 | 9454 |
| 354 | L | G | Y | V | Q | A | P | H | K | T | 10 | 9455 |
| 363 | T | L | P | V | V | F | D | S | P | R | 10 | 9456 |
| 444 | Q | V | V | R | D | F | L | H | A | Q | 10 | 9457 |
| 484 | K | G | F | R | M | L | L | A | S | P | 10 | 9458 |
| 523 | V | K | T | I | S | I | N | Q | V | L | 10 | 9459 |
| 547 | C | I | D | W | N | R | E | V | L | K | 10 | 9460 |
| 548 | I | D | W | N | R | E | V | L | K | R | 10 | 9461 |
| 573 | F | K | T | E | R | K | K | A | T | A | 10 | 9462 |
| 601 | K | P | F | G | P | I | I | N | G | C | 10 | 9463 |
| 634 | F | T | P | Y | H | M | L | H | G | E | 10 | 9464 |
| 19 | C | V | A | G | V | E | T | L | V | D | 9 | 9465 |
| 27 | V | D | I | Y | G | S | V | P | E | G | 9 | 9466 |
| 83 | P | S | N | D | L | N | D | S | H | V | 9 | 9467 |
| 97 | H | S | S | H | E | P | L | P | L | A | 9 | 9468 |
| 102 | P | L | P | L | A | Y | A | V | L | Y | 9 | 9469 |
| 139 | W | W | G | P | S | G | Y | G | G | I | 9 | 9470 |
| 145 | G | Y | G | G | I | L | L | V | N | C | 9 | 9471 |
| 171 | V | H | C | L | Q | D | L | E | D | M | 9 | 9472 |
| 193 | L | F | D | D | H | K | L | V | L | H | 9 | 9473 |
| 210 | R | A | W | V | F | H | I | C | G | P | 9 | 9474 |
| 256 | F | P | D | A | G | F | T | G | L | I | 9 | 9475 |
| 285 | F | T | D | T | V | V | F | R | V | A | 9 | 9476 |
| 287 | D | T | V | V | F | R | V | A | P | W | 9 | 9477 |
| 309 | Y | V | C | R | V | R | N | N | T | C | 9 | 9478 |
| 320 | V | D | A | V | A | E | L | A | R | K | 9 | 9479 |
| 321 | D | A | V | A | E | L | A | R | K | A | 9 | 9480 |
| 326 | L | A | R | K | A | G | C | K | L | T | 9 | 9481 |
| 351 | E | M | E | L | G | Y | V | Q | A | P | 9 | 9482 |
| 366 | V | V | F | D | S | P | R | N | G | E | 9 | 9483 |
| 400 | S | V | S | G | L | D | S | F | G | N | 9 | 9484 |
| 410 | L | E | V | S | P | P | V | V | A | N | 9 | 9485 |
| 411 | E | V | S | P | P | V | V | A | N | G | 9 | 9486 |
| 417 | V | A | N | G | K | E | Y | P | L | G | 9 | 9487 |
| 420 | G | K | E | Y | P | L | G | R | I | L | 9 | 9488 |
| 524 | K | T | I | S | I | N | Q | V | L | S | 9 | 9489 |
| 538 | I | N | Y | N | K | F | V | Q | S | C | 9 | 9490 |
| 539 | N | Y | N | K | F | V | Q | S | C | I | 9 | 9491 |
| 561 | L | A | E | C | D | I | I | D | I | P | 9 | 9492 |
| 568 | D | I | P | Q | L | F | K | T | E | R | 9 | 9493 |
| 622 | E | P | L | G | I | H | C | T | F | I | 9 | 9494 |
| 641 | H | G | E | V | H | C | G | T | N | V | 9 | 9495 |
| 21 | A | G | V | E | T | L | V | D | I | Y | 8 | 9496 |
| 26 | L | V | D | I | Y | G | S | V | P | E | 8 | 9497 |
| 30 | Y | G | S | V | P | E | G | T | E | M | 8 | 9498 |
| 32 | S | V | P | E | G | T | E | M | F | E | 8 | 9499 |

TABLE XXXVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 38 | E | M | F | E | V | Y | G | T | P | G | 8 | 9500 |
| 55 | N | M | E | R | G | R | E | R | A | D | 8 | 9501 |
| 56 | M | E | R | G | R | E | R | A | D | T | 8 | 9502 |
| 64 | D | T | R | R | W | R | F | D | A | T | 8 | 9503 |
| 116 | D | I | S | L | D | C | D | L | N | C | 8 | 9504 |
| 181 | S | V | M | V | L | R | T | Q | G | P | 8 | 9505 |
| 212 | Q | V | F | H | I | C | G | P | E | D | 8 | 9506 |
| 258 | D | A | G | F | T | G | L | I | S | F | 8 | 9507 |
| 265 | I | S | F | H | V | T | L | L | D | D | 8 | 9508 |
| 272 | L | D | D | S | N | E | D | F | S | A | 8 | 9509 |
| 292 | R | V | A | P | W | I | M | T | P | S | 8 | 9510 |
| 313 | V | R | N | N | T | C | F | V | D | A | 8 | 9511 |
| 328 | R | K | A | G | C | K | L | T | I | C | 8 | 9512 |
| 334 | L | T | I | C | P | Q | A | E | N | R | 8 | 9513 |
| 350 | D | E | M | E | L | G | Y | V | Q | A | 8 | 9514 |
| 445 | V | V | R | D | F | L | H | A | Q | K | 8 | 9515 |
| 486 | F | R | M | L | L | A | S | P | G | A | 8 | 9516 |
| 510 | R | A | L | L | F | Q | G | V | V | D | 8 | 9517 |
| 519 | D | D | E | Q | V | K | T | I | S | I | 8 | 9518 |
| 526 | I | S | I | N | Q | V | L | S | N | K | 8 | 9519 |
| 529 | N | Q | V | L | S | N | K | D | L | I | 8 | 9520 |
| 532 | L | S | N | K | D | L | I | N | Y | N | 8 | 9521 |
| 580 | A | T | F | F | P | D | L | V | N | 8 | 9522 |
| 593 | L | G | K | H | L | G | I | P | K | P | 8 | 9523 |
| 607 | I | N | G | C | C | C | L | E | E | K | 8 | 9524 |
| 74 | L | E | I | I | V | M | N | S | P | 7 | 9525 |
| 75 | E | I | I | V | V | M | N | S | P | S | 7 | 9526 |
| 112 | L | T | C | V | D | I | S | L | D | C | 7 | 9527 |
| 133 | F | V | D | K | R | Q | W | V | W | G | 7 | 9528 |
| 146 | Y | G | G | I | L | L | V | N | C | D | 7 | 9529 |
| 151 | L | V | N | C | D | R | D | D | P | S | 7 | 9530 |
| 170 | H | V | H | C | L | Q | D | L | E | D | 7 | 9531 |
| 178 | E | D | M | S | V | M | V | L | R | T | 7 | 9532 |
| 186 | R | T | Q | G | P | A | A | L | F | D | 7 | 9533 |
| 202 | H | T | S | S | Y | D | A | K | R | A | 7 | 9534 |
| 220 | E | D | V | C | E | A | Y | R | H | V | 7 | 9535 |
| 223 | C | E | A | Y | R | H | V | L | G | Q | 7 | 9536 |
| 236 | S | Y | E | V | P | R | L | H | G | D | 7 | 9537 |
| 254 | L | S | F | P | D | A | G | F | T | G | 7 | 9538 |
| 259 | A | G | F | T | G | L | I | S | F | H | 7 | 9539 |
| 279 | F | S | A | S | P | I | F | T | D | T | 7 | 9540 |
| 291 | F | R | V | A | P | W | I | M | T | P | 7 | 9541 |
| 319 | F | V | D | A | V | A | E | L | A | R | 7 | 9542 |
| 323 | V | A | E | L | A | R | K | A | G | C | 7 | 9543 |
| 353 | E | L | G | Y | V | Q | A | P | H | K | 7 | 9544 |
| 385 | L | G | P | D | F | G | Y | V | T | R | 7 | 9545 |
| 439 | G | R | R | V | T | Q | V | V | R | D | 7 | 9546 |
| 455 | V | Q | P | P | V | E | L | F | V | D | 7 | 9547 |
| 481 | P | D | G | K | G | F | R | M | L | L | 7 | 9548 |
| 506 | C | G | H | G | R | A | L | L | F | Q | 7 | 9549 |
| 530 | Q | V | L | S | N | K | D | L | I | N | 7 | 9550 |
| 567 | I | D | I | P | Q | L | F | K | T | E | 7 | 9551 |
| 605 | P | I | I | N | G | C | C | C | L | E | 7 | 9552 |
| 623 | P | L | G | L | H | C | T | F | I | D | 7 | 9553 |
| 644 | V | H | C | G | T | N | V | C | R | K | 7 | 9554 |
| 647 | G | T | N | V | C | R | K | P | F | S | 7 | 9555 |
| 654 | P | F | S | F | K | W | W | N | M | V | 7 | 9556 |
| 1 | M | S | L | Q | R | I | V | R | V | S | 6 | 9557 |
| 3 | L | Q | R | I | V | R | V | S | L | E | 6 | 9558 |
| 23 | V | E | T | L | V | D | I | Y | G | S | 6 | 9559 |
| 77 | I | V | V | M | N | S | P | S | N | D | 6 | 9560 |
| 91 | H | V | Q | I | S | Y | H | S | S | H | 6 | 9561 |
| 98 | S | S | H | E | P | L | P | L | A | Y | 6 | 9562 |
| 107 | Y | A | V | L | Y | L | T | C | V | D | 6 | 9563 |
| 128 | R | Q | D | R | N | F | V | D | K | R | 6 | 9564 |
| 174 | L | Q | D | L | E | D | M | S | V | M | 6 | 9565 |
| 187 | T | Q | G | P | A | A | L | F | D | D | 6 | 9566 |
| 195 | D | D | H | K | A | V | L | H | T | S | 6 | 9567 |
| 206 | Y | D | A | K | R | A | Q | V | F | H | 6 | 9568 |
| 224 | E | A | Y | R | H | V | L | G | Q | D | 6 | 9569 |
| 244 | G | D | E | E | R | F | F | V | E | G | 6 | 9570 |
| 266 | S | F | H | V | T | L | L | D | D | S | 6 | 9571 |
| 274 | D | S | N | E | D | F | S | A | S | P | 6 | 9572 |
| 305 | P | L | E | V | Y | V | C | R | V | R | 6 | 9573 |
| 307 | E | V | Y | V | C | R | V | R | N | N | 6 | 9574 |
| 308 | V | Y | V | C | R | V | R | N | N | T | 6 | 9575 |
| 316 | N | T | C | F | V | D | A | V | A | E | 6 | 9576 |
| 330 | A | G | C | K | L | T | I | C | P | Q | 6 | 9577 |
| 342 | N | R | N | D | R | W | I | Q | D | E | 6 | 9578 |
| 343 | R | N | D | R | W | I | Q | D | E | M | 6 | 9579 |
| 352 | M | E | L | G | Y | V | Q | A | P | H | 6 | 9580 |
| 356 | Y | V | Q | A | P | H | K | T | L | P | 6 | 9581 |
| 370 | S | P | R | N | G | E | L | Q | D | F | 6 | 9582 |
| 374 | G | E | L | Q | D | F | P | Y | K | R | 6 | 9583 |
| 379 | F | P | Y | K | R | I | L | G | P | D | 6 | 9584 |
| 402 | S | G | L | D | S | F | G | N | L | E | 6 | 9585 |
| 405 | D | S | F | G | N | L | E | V | S | P | 6 | 9586 |
| 406 | S | F | G | N | L | E | V | S | P | P | 6 | 9587 |
| 434 | L | P | G | S | S | G | R | R | V | T | 6 | 9588 |
| 461 | L | F | V | D | W | L | A | V | G | H | 6 | 9589 |
| 467 | A | V | G | H | V | D | E | F | L | S | 6 | 9590 |
| 470 | H | V | D | E | F | L | S | F | V | P | 6 | 9591 |
| 472 | D | E | F | L | S | F | V | P | A | P | 6 | 9592 |
| 476 | S | F | V | P | A | P | D | G | K | G | 6 | 9593 |
| 479 | P | A | P | D | G | K | G | F | R | M | 6 | 9594 |
| 483 | G | K | G | F | R | M | L | L | A | S | 6 | 9595 |
| 494 | G | A | C | F | K | L | F | Q | E | K | 6 | 9596 |
| 513 | L | F | Q | G | V | V | D | D | E | Q | 6 | 9597 |
| 595 | K | H | L | G | I | P | K | P | F | G | 6 | 9598 |
| 616 | K | V | R | S | L | L | E | P | L | G | 6 | 9599 |
| 618 | R | S | L | L | E | P | L | G | L | H | 6 | 9600 |
| 626 | L | H | C | T | F | I | D | D | F | T | 6 | 9601 |
| 640 | L | H | G | E | V | H | C | G | T | N | 6 | 9602 |
| 653 | K | P | F | S | F | K | W | W | N | M | 6 | 9603 |
| 4 | Q | R | I | V | R | V | S | L | E | H | 5 | 9604 |
| 12 | E | H | P | T | S | A | V | C | V | A | 5 | 9605 |
| 42 | V | Y | G | T | P | G | V | D | I | Y | 5 | 9606 |
| 53 | S | P | N | M | E | R | G | R | E | R | 5 | 9607 |
| 63 | A | D | T | R | R | W | R | F | D | A | 5 | 9608 |
| 81 | N | S | P | S | N | D | L | N | D | S | 5 | 9609 |
| 90 | S | H | V | Q | I | S | Y | H | S | S | 5 | 9610 |
| 113 | T | C | V | D | I | S | L | D | C | D | 5 | 9611 |
| 134 | V | D | K | R | Q | W | V | W | G | P | 5 | 9612 |
| 152 | V | N | C | D | R | D | D | P | S | C | 5 | 9613 |
| 201 | L | H | T | S | S | Y | D | A | K | R | 5 | 9614 |
| 235 | V | S | Y | E | V | P | R | L | H | G | 5 | 9615 |
| 248 | R | F | F | V | E | G | L | S | F | P | 5 | 9616 |
| 278 | D | F | S | A | S | P | I | F | T | D | 5 | 9617 |
| 282 | S | P | I | F | T | D | T | V | V | F | 5 | 9618 |
| 290 | V | F | R | V | A | P | W | I | M | T | 5 | 9619 |
| 298 | M | T | P | S | T | L | P | P | L | E | 5 | 9620 |
| 315 | N | N | T | C | F | V | D | A | V | A | 5 | 9621 |
| 318 | C | F | V | D | A | V | A | E | L | A | 5 | 9622 |
| 329 | K | A | G | C | K | L | T | I | C | P | 5 | 9623 |
| 331 | G | C | K | L | T | I | C | P | Q | A | 5 | 9624 |
| 391 | Y | V | T | R | E | P | R | D | R | S | 5 | 9625 |
| 398 | R | S | V | S | G | L | D | S | F | S | 5 | 9626 |
| 404 | L | D | S | F | G | N | L | E | V | S | 5 | 9627 |
| 412 | V | S | P | P | V | V | A | N | G | K | 5 | 9628 |
| 432 | G | N | L | P | G | S | S | G | R | R | 5 | 9629 |
| 442 | V | T | Q | V | V | R | D | F | L | H | 5 | 9630 |
| 443 | T | Q | V | V | R | D | F | L | H | A | 5 | 9631 |
| 451 | H | A | Q | K | V | Q | P | P | V | E | 5 | 9632 |
| 471 | V | D | E | F | L | S | F | V | P | A | 5 | 9633 |
| 477 | F | V | P | A | P | D | G | K | G | F | 5 | 9634 |
| 478 | V | P | A | P | D | G | K | G | F | R | 5 | 9635 |
| 482 | D | G | K | G | F | R | M | L | L | A | 5 | 9636 |
| 495 | A | C | F | K | L | F | Q | E | K | Q | 5 | 9637 |
| 499 | L | F | Q | E | K | Q | K | C | G | H | 5 | 9638 |
| 507 | G | H | G | R | A | L | L | F | Q | G | 5 | 9639 |
| 542 | K | F | V | Q | S | C | I | D | W | N | 5 | 9640 |
| 543 | F | V | Q | S | C | I | D | W | N | R | 5 | 9641 |
| 572 | L | F | K | T | E | R | K | K | A | T | 5 | 9642 |
| 574 | K | T | E | R | K | K | A | T | A | F | 5 | 9643 |
| 585 | P | D | L | V | N | M | L | V | L | G | 5 | 9644 |
| 628 | C | T | F | I | D | D | F | T | P | Y | 5 | 9645 |
| 637 | Y | H | M | L | H | G | E | V | H | C | 5 | 9646 |
| 7 | R | V | R | V | S | L | E | H | P | T | 4 | 9647 |
| 22 | G | V | E | T | L | V | D | I | Y | G | 4 | 9648 |
| 29 | I | Y | G | S | V | P | E | G | T | E | 4 | 9649 |
| 50 | I | Y | I | S | P | N | M | E | R | G | 4 | 9650 |
| 54 | P | N | M | E | R | G | R | E | R | A | 4 | 9651 |

TABLE XXXVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 62 | R | A | D | T | R | R | W | R | F | D | 4 | 9652 |
| 82 | S | P | S | N | D | L | N | D | S | H | 4 | 9653 |
| 87 | L | N | D | S | H | V | Q | I | S | Y | 4 | 9654 |
| 88 | N | D | S | H | V | Q | I | S | Y | H | 4 | 9655 |
| 119 | L | D | C | D | L | N | C | E | G | R | 4 | 9656 |
| 123 | L | N | C | E | G | R | Q | D | R | N | 4 | 9657 |
| 127 | G | R | Q | D | R | N | F | V | D | K | 4 | 9658 |
| 136 | K | R | Q | W | V | W | G | P | S | G | 4 | 9659 |
| 156 | R | D | D | P | S | C | D | V | Q | D | 4 | 9660 |
| 177 | L | E | D | M | S | V | M | V | L | R | 4 | 9661 |
| 197 | H | K | L | V | L | H | T | S | S | Y | 4 | 9662 |
| 234 | K | V | S | Y | E | V | P | R | L | H | 4 | 9663 |
| 237 | Y | E | V | P | R | L | H | G | D | E | 4 | 9664 |
| 303 | L | P | P | L | E | V | Y | V | C | R | 4 | 9665 |
| 312 | R | V | R | N | N | T | C | F | V | D | 4 | 9666 |
| 324 | A | E | L | A | R | K | A | G | C | K | 4 | 9667 |
| 359 | A | P | H | K | T | L | P | V | V | F | 4 | 9668 |
| 378 | D | F | P | Y | K | R | I | L | G | P | 4 | 9669 |
| 382 | K | R | I | L | G | P | D | F | G | Y | 4 | 9670 |
| 386 | G | P | D | F | G | Y | V | T | R | E | 4 | 9671 |
| 394 | R | E | P | R | D | R | S | V | S | G | 4 | 9672 |
| 413 | S | P | P | V | V | A | N | G | K | E | 4 | 9673 |
| 418 | A | N | G | K | E | Y | P | L | G | R | 4 | 9674 |
| 426 | G | R | I | L | I | G | G | N | L | P | 4 | 9675 |
| 430 | I | G | G | N | L | P | G | S | S | G | 4 | 9676 |
| 438 | S | G | R | R | V | T | Q | V | V | R | 4 | 9677 |
| 440 | R | R | V | T | Q | V | V | R | D | F | 4 | 9678 |
| 453 | Q | K | V | Q | P | P | V | E | L | F | 4 | 9679 |
| 458 | P | V | E | L | F | V | D | W | L | A | 4 | 9680 |
| 468 | V | G | H | V | D | E | F | L | S | F | 4 | 9681 |
| 475 | L | S | F | V | P | A | P | D | G | K | 4 | 9682 |
| 497 | F | K | L | F | Q | E | K | Q | K | C | 4 | 9683 |
| 559 | L | G | L | A | E | C | D | I | I | D | 4 | 9684 |
| 621 | L | E | P | L | G | L | H | C | T | F | 4 | 9685 |
| 624 | L | G | L | H | C | T | F | I | D | D | 4 | 9686 |
| 629 | T | F | I | D | D | F | T | P | Y | H | 4 | 9687 |
| 649 | N | V | C | R | K | P | F | S | F | K | 4 | 9688 |
| 31 | G | S | V | P | E | G | T | E | M | F | 3 | 9689 |
| 48 | V | D | I | Y | I | S | P | N | M | E | 3 | 9690 |
| 80 | M | N | S | P | S | N | D | L | N | D | 3 | 9691 |
| 84 | S | N | D | L | N | D | S | H | V | Q | 3 | 9692 |
| 92 | V | Q | I | S | Y | H | S | S | H | E | 3 | 9693 |
| 95 | S | Y | H | S | S | H | E | P | L | P | 3 | 9694 |
| 115 | V | D | I | S | L | D | C | D | L | N | 3 | 9695 |
| 147 | G | G | I | L | L | V | N | C | D | R | 3 | 9696 |
| 157 | D | D | P | S | C | D | V | Q | D | N | 3 | 9697 |
| 164 | Q | D | N | C | D | Q | H | V | H | C | 3 | 9698 |
| 185 | L | R | T | Q | G | P | A | A | L | F | 3 | 9699 |
| 189 | G | P | A | A | L | F | D | D | H | K | 3 | 9700 |
| 208 | A | K | R | A | Q | V | F | H | I | C | 3 | 9701 |
| 209 | K | R | A | Q | V | F | H | I | C | G | 3 | 9702 |
| 214 | F | H | I | C | G | P | E | D | V | C | 3 | 9703 |
| 217 | C | G | P | E | D | V | C | E | A | Y | 3 | 9704 |
| 218 | G | P | E | D | V | C | E | A | Y | R | 3 | 9705 |
| 238 | E | V | P | R | L | H | G | D | E | E | 3 | 9706 |
| 239 | V | P | R | L | H | G | D | E | E | R | 3 | 9707 |
| 249 | F | F | V | E | G | L | S | F | P | D | 3 | 9708 |
| 267 | F | H | V | T | L | L | D | D | S | N | 3 | 9709 |
| 268 | H | V | T | L | L | D | D | S | N | E | 3 | 9710 |
| 306 | L | E | V | Y | V | C | R | V | R | N | 3 | 9711 |
| 332 | C | K | L | T | I | C | P | Q | A | E | 3 | 9712 |
| 340 | A | E | N | R | N | D | R | W | I | Q | 3 | 9713 |
| 361 | H | K | T | L | P | V | V | F | D | S | 3 | 9714 |
| 364 | L | P | V | V | F | D | S | P | R | N | 3 | 9715 |
| 368 | F | D | S | P | R | N | G | E | L | Q | 3 | 9716 |
| 377 | Q | D | F | P | Y | K | R | I | L | G | 3 | 9717 |
| 389 | F | G | Y | V | T | R | E | P | R | D | 3 | 9718 |
| 431 | G | G | N | L | P | G | S | S | G | R | 3 | 9719 |
| 448 | D | F | L | H | A | Q | K | V | Q | P | 3 | 9720 |
| 463 | V | D | W | L | A | V | G | H | V | D | 3 | 9721 |
| 464 | D | W | L | A | V | G | H | V | D | E | 3 | 9722 |
| 491 | A | S | P | G | A | C | F | K | L | F | 3 | 9723 |
| 492 | S | P | G | A | C | F | K | L | F | Q | 3 | 9724 |
| 493 | P | G | A | C | F | K | L | F | Q | E | 3 | 9725 |
| 518 | V | D | D | E | Q | V | K | T | I | S | 3 | 9726 |
| 520 | D | E | Q | V | K | T | I | S | I | N | 3 | 9727 |
| 533 | S | N | K | D | L | I | N | Y | N | K | 3 | 9728 |
| 534 | N | K | D | L | I | N | Y | N | K | F | 3 | 9729 |
| 549 | D | W | N | R | E | V | L | K | R | E | 3 | 9730 |
| 562 | A | E | C | D | I | I | D | I | P | Q | 3 | 9731 |
| 599 | I | P | K | P | F | G | P | I | I | N | 3 | 9732 |
| 614 | E | E | K | V | R | S | L | L | E | P | 3 | 9733 |
| 643 | E | V | H | C | G | T | N | V | C | R | 3 | 9734 |
| 650 | V | C | R | K | P | F | S | F | K | W | 3 | 9735 |
| 13 | H | P | T | S | A | V | C | V | A | G | 2 | 9736 |
| 15 | T | S | A | V | C | V | A | G | V | E | 2 | 9737 |
| 37 | T | E | M | F | E | V | Y | G | T | P | 2 | 9738 |
| 45 | T | P | G | V | D | I | Y | I | S | P | 2 | 9739 |
| 46 | P | G | V | D | I | Y | I | S | P | N | 2 | 9740 |
| 52 | I | S | P | N | M | E | R | G | R | E | 2 | 9741 |
| 58 | R | G | R | E | R | A | D | T | R | R | 2 | 9742 |
| 121 | C | D | L | N | C | E | G | R | Q | D | 2 | 9743 |
| 137 | R | Q | W | V | W | G | P | S | G | Y | 2 | 9744 |
| 160 | S | C | D | V | Q | D | N | C | D | Q | 2 | 9745 |
| 163 | V | Q | D | N | C | D | Q | H | V | H | 2 | 9746 |
| 172 | H | C | L | Q | D | L | E | D | M | S | 2 | 9747 |
| 205 | S | Y | D | A | K | R | A | Q | V | F | 2 | 9748 |
| 222 | V | C | E | A | Y | R | H | V | L | G | 2 | 9749 |
| 225 | A | Y | R | H | V | L | G | Q | D | K | 2 | 9750 |
| 243 | H | G | D | E | E | R | F | F | V | E | 2 | 9751 |
| 251 | V | E | G | L | S | F | P | D | A | G | 2 | 9752 |
| 252 | E | G | L | S | F | P | D | A | G | F | 2 | 9753 |
| 257 | P | D | A | G | F | T | G | L | I | S | 2 | 9754 |
| 277 | E | D | F | S | A | S | P | I | F | T | 2 | 9755 |
| 286 | T | D | T | V | V | F | R | V | A | P | 2 | 9756 |
| 336 | I | C | P | Q | A | E | N | R | N | D | 2 | 9757 |
| 346 | R | W | I | Q | D | E | M | E | L | G | 2 | 9758 |
| 360 | P | H | K | T | L | P | V | V | F | D | 2 | 9759 |
| 372 | R | N | G | E | L | Q | D | F | P | Y | 2 | 9760 |
| 381 | Y | K | R | I | L | G | P | D | F | G | 2 | 9761 |
| 387 | P | D | F | G | Y | V | T | R | E | P | 2 | 9762 |
| 422 | E | Y | P | L | G | R | I | L | I | G | 2 | 9763 |
| 456 | Q | P | P | V | E | L | F | V | D | W | 2 | 9764 |
| 505 | K | C | G | H | G | R | A | L | L | F | 2 | 9765 |
| 544 | V | Q | S | C | I | D | W | N | R | E | 2 | 9766 |
| 564 | C | D | I | I | D | I | P | Q | L | F | 2 | 9767 |
| 569 | I | P | Q | L | F | K | T | E | R | K | 2 | 9768 |
| 575 | T | E | R | K | K | A | T | A | F | F | 2 | 9769 |
| 610 | C | C | C | L | E | E | K | V | R | S | 2 | 9770 |
| 613 | L | E | E | K | V | R | S | L | L | E | 2 | 9771 |
| 642 | G | E | V | H | C | G | T | N | V | C | 2 | 9772 |
| 645 | H | C | G | T | N | V | C | R | K | P | 2 | 9773 |
| 648 | T | N | V | C | R | K | P | F | S | F | 2 | 9774 |
| 655 | F | S | F | K | W | W | N | M | V | P | 2 | 9775 |
| 66 | R | R | W | R | F | D | A | T | L | E | 1 | 9776 |
| 124 | N | C | E | G | R | Q | D | R | N | F | 1 | 9777 |
| 132 | N | F | V | D | K | R | Q | W | V | W | 1 | 9778 |
| 167 | C | D | Q | H | V | H | C | L | Q | D | 1 | 9779 |
| 211 | A | Q | V | F | H | I | C | G | P | E | 1 | 9780 |
| 231 | S | Q | D | K | V | S | Y | E | V | P | 1 | 9781 |
| 232 | Q | D | K | V | S | Y | E | V | P | R | 1 | 9782 |
| 310 | V | C | R | V | R | N | N | T | C | F | 1 | 9783 |
| 337 | C | P | Q | A | E | N | R | N | D | R | 1 | 9784 |
| 338 | P | Q | A | E | N | R | N | D | R | W | 1 | 9785 |
| 390 | G | Y | V | T | R | E | P | R | D | R | 1 | 9786 |
| 393 | T | R | E | P | R | D | R | S | V | S | 1 | 9787 |
| 397 | R | D | R | S | V | S | G | L | D | S | 1 | 9788 |
| 415 | P | V | V | A | N | G | K | E | Y | P | 1 | 9789 |
| 435 | P | G | S | S | G | R | R | V | T | Q | 1 | 9790 |
| 473 | E | F | L | S | F | V | P | A | P | D | 1 | 9791 |
| 485 | G | F | R | M | L | L | A | S | P | G | 1 | 9792 |
| 501 | Q | E | K | Q | K | C | G | H | G | R | 1 | 9793 |
| 502 | E | K | Q | K | C | G | H | G | R | A | 1 | 9794 |
| 541 | N | K | F | V | Q | S | C | I | D | W | 1 | 9795 |
| 603 | F | G | P | I | I | N | G | C | C | C | 1 | 9796 |
| 633 | D | F | T | P | Y | H | M | L | H | M | 1 | 9797 |
| 57 | E | R | G | R | E | R | A | D | T | R | -1 | 9798 |
| 120 | D | C | D | L | N | C | E | G | R | Q | -1 | 9799 |
| 129 | Q | D | R | N | F | V | D | K | R | Q | -1 | 9800 |
| 130 | D | R | N | F | V | D | K | R | Q | W | -1 | 9801 |
| 135 | D | K | R | Q | W | V | W | G | P | S | -1 | 9802 |
| 158 | D | P | S | C | D | V | Q | D | N | C | -1 | 9803 |

TABLE XXXVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 159 | P | S | C | D | V | Q | D | N | C | D | -1 | 9804 |
| 227 | R | H | V | L | G | Q | D | K | V | S | -1 | 9805 |
| 240 | P | R | L | H | G | D | E | E | R | F | -1 | 9806 |
| 295 | P | W | I | M | T | P | S | T | L | P | -1 | 9807 |
| 551 | N | R | E | V | L | K | R | E | L | G | -1 | 9808 |
| 577 | R | K | K | A | T | A | F | F | P | D | -1 | 9809 |
| 602 | P | F | G | P | I | I | N | G | C | C | -1 | 9810 |
| 652 | R | K | P | F | S | F | K | W | W | N | -1 | 9811 |
| 219 | P | E | D | V | C | E | A | Y | R | H | -2 | 9812 |
| 388 | D | F | G | Y | V | T | R | E | P | R | -2 | 9813 |
| 414 | P | P | V | V | A | N | G | K | E | Y | -2 | 9814 |
| 496 | C | F | K | L | F | Q | E | K | Q | K | -2 | 9815 |
| 646 | C | G | T | N | V | C | R | K | P | F | -2 | 9816 |
| 34 | P | E | G | T | E | M | F | E | V | Y | -2 | 9817 |
| 126 | E | G | R | Q | D | R | N | F | V | D | -3 | 9818 |
| 341 | E | N | R | N | D | R | W | I | Q | D | -3 | 9819 |
| 380 | P | Y | K | R | I | L | G | P | D | F | -3 | 9820 |
| 396 | P | R | D | R | S | V | S | G | L | D | -3 | 9821 |
| 521 | E | Q | V | K | T | I | S | I | N | Q | -3 | 9822 |
| 636 | P | Y | H | M | L | H | G | E | V | H | -3 | 9823 |
| 246 | E | E | R | F | F | V | E | G | L | S | -4 | 9824 |
| 576 | E | R | K | K | A | T | A | F | F | P | -4 | 9825 |

184P1E2 v.2: HLA Peptide Scoring Results A0201 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 3 | I | M | T | P | S | T | L | A | P | L | 27 | 9826 |
| 7 | S | T | L | A | P | L | E | V | Y | V | 20 | 9827 |
| 10 | A | P | L | E | V | Y | V | C | R | V | 20 | 9828 |
| 8 | T | L | A | P | L | E | V | Y | V | C | 19 | 9829 |
| 5 | T | P | S | T | L | A | P | L | E | V | 13 | 9830 |
| 2 | W | I | M | T | P | S | T | L | A | P | 11 | 9831 |
| 9 | L | A | P | L | E | V | Y | V | C | R | 8 | 9832 |
| 4 | M | T | P | S | T | L | A | P | L | E | 5 | 9833 |
| 1 | P | W | I | M | T | P | S | T | L | A | 3 | 9834 |

184P1E2 v.3: HLA Peptide Scoring Results A0201 10-mers SYFPEITHI

| Pos | 1 | 2 | 3 | 4 | 5 | 6 | 7 | 8 | 9 | 0 | score |
|---|---|---|---|---|---|---|---|---|---|---|---|
| 4 | F | L | S | F | V | P | V | P | D | G | 15 |
| 10 | V | P | D | G | K | G | F | R | M | L | 13 |
| 1 | V | D | E | F | L | S | F | V | P | V | 11 |
| 6 | S | F | V | P | V | P | D | G | K | G | 6 |
| 9 | P | V | P | D | G | K | G | F | R | M | 6 |
| 2 | D | E | F | L | S | F | V | P | V | P | 5 |
| 7 | F | V | P | V | P | D | G | K | G | F | 5 |
| 5 | L | S | F | V | P | V | P | D | G | K | 4 |
| 8 | V | P | V | P | D | G | K | G | F | R | 3 |
| 3 | E | F | L | S | F | V | P | V | P | D | 1 |

TABLE XXXVII

| Pos | 1 | 2 | 3 | 4 | 5 | 6 | 7 | 8 | 9 | 0 | score | SEQ. ID NO. |
|---|---|---|---|---|---|---|---|---|---|---|---|---|

184P1E2 v.1: HLA Peptide Scoring Results A202 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 190 | P | A | L | F | D | D | H | K | L | | 5 | 9835 |
| 106 | A | Y | A | V | L | Y | L | T | C | V | 4 | 9836 |
| 322 | A | V | A | E | L | A | R | K | A | G | 4 | 9837 |
| 580 | A | T | A | F | F | P | D | L | V | N | 4 | 9838 |
| 15 | T | S | A | V | C | V | A | G | V | E | 3 | 9839 |
| 19 | C | V | A | G | V | E | T | L | V | D | 3 | 9840 |
| 61 | E | R | A | D | T | R | R | W | R | F | 3 | 9841 |
| 70 | F | D | A | T | L | E | I | I | V | V | 3 | 9842 |
| 104 | P | L | A | Y | A | V | L | Y | L | T | 3 | 9843 |
| 189 | G | P | A | A | L | F | D | D | H | K | 3 | 9844 |
| 191 | A | A | L | F | D | D | H | K | L | V | 3 | 9845 |
| 206 | Y | D | A | K | R | A | Q | V | F | H | 3 | 9846 |
| 209 | K | R | A | Q | V | F | H | I | C | G | 3 | 9847 |
| 223 | C | E | A | Y | R | H | V | L | G | Q | 3 | 9848 |
| 257 | P | D | A | G | F | T | G | L | I | S | 3 | 9849 |
| 279 | F | S | A | S | P | I | F | T | D | T | 3 | 9850 |
| 292 | R | V | A | P | W | I | M | T | P | S | 3 | 9851 |

TABLE XXXVII-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 320 | V | D | A | V | A | E | L | A | R | K | 3 | 9852 |
| 325 | E | L | A | R | K | A | G | C | K | L | 3 | 9853 |
| 328 | R | K | A | G | C | K | L | T | I | C | 3 | 9854 |
| 338 | P | Q | A | E | N | R | N | D | R | W | 3 | 9855 |
| 357 | V | Q | A | P | H | K | T | L | P | V | 3 | 9856 |
| 416 | V | V | A | N | G | K | E | Y | P | L | 3 | 9857 |
| 450 | L | H | A | Q | K | V | Q | P | P | V | 3 | 9858 |
| 465 | W | L | A | V | G | H | V | D | E | F | 3 | 9859 |
| 478 | V | P | A | P | D | G | K | G | F | R | 3 | 9860 |
| 489 | L | L | A | S | P | G | A | C | F | K | 3 | 9861 |
| 493 | P | G | A | C | F | K | L | F | Q | E | 3 | 9862 |
| 509 | G | R | A | L | L | F | Q | G | V | V | 3 | 9863 |
| 560 | G | L | A | E | C | D | I | I | D | I | 3 | 9864 |
| 578 | K | K | A | T | A | F | F | P | D | L | 3 | 9865 |
| 16 | S | A | V | C | V | A | G | V | E | T | 2 | 9866 |
| 20 | V | A | G | V | E | T | L | V | D | I | 2 | 9867 |
| 62 | R | A | D | T | R | R | W | R | F | D | 2 | 9868 |
| 71 | D | A | T | L | E | I | I | V | V | M | 2 | 9869 |
| 105 | L | A | Y | A | V | L | Y | L | T | C | 2 | 9870 |
| 107 | Y | A | V | L | Y | L | T | C | V | D | 2 | 9871 |
| 207 | D | A | K | R | A | Q | V | F | H | I | 2 | 9872 |
| 210 | R | A | Q | V | F | H | I | C | G | P | 2 | 9873 |
| 224 | E | A | Y | R | H | V | L | G | Q | D | 2 | 9874 |
| 258 | D | A | G | F | T | G | L | I | S | F | 2 | 9875 |
| 280 | S | A | S | P | I | F | T | D | T | V | 2 | 9876 |
| 293 | V | A | P | W | I | M | T | P | S | T | 2 | 9877 |
| 321 | D | A | V | A | E | L | A | R | K | A | 2 | 9878 |
| 323 | V | A | E | L | A | R | K | A | G | C | 2 | 9879 |
| 326 | L | A | R | K | A | G | C | K | L | T | 2 | 9880 |
| 329 | K | A | G | C | K | L | T | I | C | P | 2 | 9881 |
| 339 | Q | A | E | N | R | N | D | R | W | I | 2 | 9882 |
| 358 | Q | A | P | H | K | T | L | P | V | V | 2 | 9883 |
| 417 | V | A | N | G | K | E | Y | P | L | G | 2 | 9884 |
| 451 | H | A | Q | K | V | Q | P | P | V | E | 2 | 9885 |
| 466 | L | A | V | G | H | V | D | E | F | L | 2 | 9886 |
| 479 | P | A | P | D | G | K | G | F | R | M | 2 | 9887 |
| 490 | L | A | S | P | G | A | C | F | K | L | 2 | 9888 |
| 494 | G | A | C | F | K | L | F | Q | E | K | 2 | 9889 |
| 510 | R | A | L | L | F | Q | G | V | V | D | 2 | 9890 |
| 561 | L | A | E | C | D | I | I | D | I | P | 2 | 9891 |
| 579 | K | A | T | A | F | F | P | D | L | V | 2 | 9892 |
| 581 | T | A | F | F | P | D | L | V | N | M | 2 | 9893 |
| 17 | A | V | C | V | A | G | V | E | T | L | 1 | 9894 |
| 21 | A | G | V | E | T | L | V | D | I | Y | 1 | 9895 |
| 63 | A | D | T | R | R | W | R | F | D | A | 1 | 9896 |
| 72 | A | T | L | E | I | I | V | V | M | N | 1 | 9897 |
| 108 | A | V | L | Y | L | T | C | V | D | I | 1 | 9898 |
| 192 | A | L | F | D | D | H | K | L | V | L | 1 | 9899 |
| 208 | A | K | R | A | Q | V | F | H | I | C | 1 | 9900 |
| 211 | A | Q | V | F | H | I | C | G | P | E | 1 | 9901 |
| 225 | A | Y | R | H | V | L | G | Q | D | K | 1 | 9902 |
| 259 | A | G | F | T | G | L | I | S | F | H | 1 | 9903 |
| 281 | A | S | P | I | F | T | D | T | V | V | 1 | 9904 |
| 294 | A | P | W | I | M | T | P | S | T | L | 1 | 9905 |
| 324 | A | E | L | A | R | K | A | G | C | K | 1 | 9906 |
| 327 | A | R | K | A | G | C | K | L | T | I | 1 | 9907 |
| 330 | A | G | C | K | L | T | I | C | P | Q | 1 | 9908 |
| 340 | A | E | N | R | N | D | R | W | I | Q | 1 | 9909 |
| 359 | A | P | H | K | T | L | P | V | V | F | 1 | 9910 |
| 418 | A | N | G | K | E | Y | P | L | G | R | 1 | 9911 |
| 452 | A | Q | K | V | Q | P | P | V | E | L | 1 | 9912 |
| 467 | A | V | G | H | V | D | E | F | L | S | 1 | 9913 |
| 480 | A | P | D | G | K | G | F | R | M | L | 1 | 9914 |
| 491 | A | S | P | G | A | C | F | K | L | F | 1 | 9915 |
| 495 | A | C | F | K | L | F | Q | E | K | Q | 1 | 9916 |
| 511 | A | L | L | F | Q | G | V | V | D | D | 1 | 9917 |
| 562 | A | E | C | D | I | I | D | I | P | Q | 1 | 9918 |
| 582 | A | F | F | P | D | L | V | N | M | L | 1 | 9919 |

184P1E2 v.2: HLA Peptide Scoring Results A0202 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 8 | T | L | A | P | L | E | V | Y | V | C | 3 | 9920 |
| 9 | L | A | P | L | E | V | Y | V | C | R | 2 | 9921 |
| 10 | A | P | L | E | V | Y | V | C | R | V | 1 | 9922 |

TABLE XXXVIII

| Pos | 1 | 2 | 3 | 4 | 5 | 6 | 7 | 8 | 9 | 0 | score | SEQ. ID NO. |
|---|---|---|---|---|---|---|---|---|---|---|---|---|
| \multicolumn{12}{c}{184P1E2 v.1: HLA Peptide Scoring Results A203 10-mers SYFPEITHI} | |
| 183 | M | V | L | R | T | Q | G | P | A | A | 19 | 9923 |
| 99 | S | H | E | P | L | P | L | A | Y | A | 18 | 9924 |
| 315 | N | N | T | C | F | V | D | A | V | A | 18 | 9925 |
| 573 | F | K | T | E | R | K | K | A | T | A | 18 | 9926 |
| 184 | V | L | R | T | Q | G | P | A | A | L | 17 | 9927 |
| 8 | R | V | S | L | E | H | P | T | S | A | 10 | 9928 |
| 12 | E | H | P | T | S | A | V | C | V | A | 10 | 9929 |
| 54 | P | N | M | E | R | G | R | E | R | A | 10 | 9930 |
| 63 | A | D | T | R | R | W | R | F | D | A | 10 | 9931 |
| 97 | H | S | S | H | E | P | L | P | L | A | 10 | 9932 |
| 182 | V | M | V | L | R | T | Q | G | P | A | 10 | 9933 |
| 199 | L | V | L | H | T | S | S | Y | D | A | 10 | 9934 |
| 202 | H | T | S | S | Y | D | A | K | R | A | 10 | 9935 |
| 216 | I | C | G | P | E | D | V | C | E | A | 10 | 9936 |
| 250 | F | V | E | G | L | S | F | P | D | A | 10 | 9937 |
| 272 | L | D | D | S | N | E | D | F | S | A | 10 | 9938 |
| 285 | F | T | D | T | V | V | F | R | V | A | 10 | 9939 |
| 313 | V | R | N | N | T | C | F | V | D | A | 10 | 9940 |
| 318 | C | F | V | D | A | V | A | E | L | A | 10 | 9941 |
| 321 | D | A | V | A | E | L | A | R | K | A | 10 | 9942 |
| 331 | G | C | K | L | T | I | C | P | Q | A | 10 | 9943 |
| 350 | D | E | M | E | L | G | Y | V | Q | A | 10 | 9944 |
| 409 | N | L | E | V | S | P | P | V | V | A | 10 | 9945 |
| 443 | T | Q | V | V | R | D | F | L | H | A | 10 | 9946 |
| 458 | P | V | E | L | F | V | D | W | L | A | 10 | 9947 |
| 471 | V | D | E | F | L | S | F | V | P | A | 10 | 9948 |
| 482 | D | G | K | G | F | R | M | L | L | A | 10 | 9949 |
| 486 | F | R | M | L | L | A | S | P | G | A | 10 | 9950 |
| 502 | E | K | Q | K | C | G | H | G | R | A | 10 | 9951 |
| 553 | E | V | L | K | R | E | L | G | L | A | 10 | 9952 |
| 571 | Q | L | F | K | T | E | R | K | K | A | 10 | 9953 |
| 9 | V | S | L | E | H | P | T | S | A | V | 9 | 9954 |
| 13 | H | P | T | S | A | V | C | V | A | G | 9 | 9955 |
| 55 | N | M | E | R | G | R | E | R | A | D | 9 | 9956 |
| 64 | D | T | R | R | W | R | F | D | A | T | 9 | 9957 |
| 98 | S | S | H | E | P | L | P | L | A | Y | 9 | 9958 |
| 100 | H | E | P | L | P | L | A | Y | A | V | 9 | 9959 |
| 200 | V | L | H | T | S | S | Y | D | A | K | 9 | 9960 |
| 203 | T | S | S | Y | D | A | K | R | A | Q | 9 | 9961 |
| 217 | C | G | P | E | D | V | C | E | A | Y | 9 | 9962 |
| 251 | V | E | G | L | S | F | P | D | A | G | 9 | 9963 |
| 273 | D | D | S | N | E | D | F | S | A | S | 9 | 9964 |
| 286 | T | D | T | V | V | F | R | V | A | P | 9 | 9965 |
| 314 | R | N | N | T | C | F | V | D | A | V | 9 | 9966 |
| 316 | N | T | C | F | V | D | A | V | A | E | 9 | 9967 |
| 319 | F | V | D | A | V | A | E | L | A | R | 9 | 9968 |
| 322 | A | V | A | E | L | A | R | K | A | G | 9 | 9969 |
| 332 | C | K | L | T | I | C | P | Q | A | E | 9 | 9970 |
| 351 | E | M | E | L | G | Y | V | Q | A | P | 9 | 9971 |
| 410 | L | E | V | S | P | P | V | V | A | N | 9 | 9972 |
| 444 | Q | V | V | R | D | F | L | H | A | Q | 9 | 9973 |
| 459 | V | E | L | F | V | D | W | L | A | V | 9 | 9974 |
| 472 | D | E | F | L | S | F | V | P | A | P | 9 | 9975 |
| 483 | G | K | G | F | R | M | L | L | A | S | 9 | 9976 |
| 487 | R | M | L | L | A | S | P | G | A | C | 9 | 9977 |
| 503 | K | Q | K | C | G | H | G | R | A | L | 9 | 9978 |
| 554 | V | L | K | R | E | L | G | L | A | E | 9 | 9979 |
| 572 | L | F | K | T | E | R | K | K | A | T | 9 | 9980 |
| 574 | K | T | E | R | K | K | A | T | A | F | 9 | 9981 |
| 10 | S | L | E | H | P | T | S | A | V | C | 8 | 9982 |
| 14 | P | T | S | A | V | C | V | A | G | V | 8 | 9983 |
| 56 | M | E | R | G | R | E | R | A | D | T | 8 | 9984 |
| 65 | T | R | R | W | R | F | D | A | T | L | 8 | 9985 |
| 101 | E | P | L | P | L | A | Y | A | V | L | 8 | 9986 |
| 185 | L | R | T | Q | G | P | A | A | L | F | 8 | 9987 |
| 201 | L | H | T | S | S | Y | D | A | K | R | 8 | 9988 |
| 204 | S | S | Y | D | A | K | R | A | Q | V | 8 | 9989 |
| 218 | G | P | E | D | V | C | E | A | Y | R | 8 | 9990 |
| 252 | E | G | L | S | F | P | D | A | G | F | 8 | 9991 |
| 274 | D | S | N | E | D | F | S | A | S | P | 8 | 9992 |
| 287 | D | T | V | V | F | R | V | A | P | W | 8 | 9993 |
| 317 | T | C | F | V | D | A | V | A | E | L | 8 | 9994 |
| 320 | V | D | A | V | A | E | L | A | R | K | 8 | 9995 |
| 323 | V | A | E | L | A | R | K | A | G | C | 8 | 9996 |
| 333 | K | L | T | I | C | P | Q | A | E | N | 8 | 9997 |
| 352 | M | E | L | G | Y | V | Q | A | P | H | 8 | 9998 |
| 411 | E | V | S | P | P | V | V | A | N | G | 8 | 9999 |
| 455 | V | V | R | D | F | L | H | A | Q | K | 8 | 10000 |
| 460 | E | L | F | V | D | W | L | A | V | G | 8 | 10001 |
| 473 | E | F | L | S | F | V | P | A | P | D | 8 | 10002 |
| 484 | K | G | F | R | M | L | L | A | S | P | 8 | 10003 |
| 488 | M | L | L | A | S | P | G | A | C | F | 8 | 10004 |
| 504 | Q | K | C | G | H | G | R | A | L | L | 8 | 10005 |
| 555 | L | K | R | E | L | G | L | A | E | C | 8 | 10006 |
| 575 | T | E | R | K | K | A | T | A | F | F | 8 | 10007 |
| \multicolumn{12}{c}{184P1E2 v.2: HLA Peptide Scoring Results A203 10-mers SYFPEITHI} | |
| 1 | P | W | I | M | T | P | S | T | L | A | 10 | 10008 |
| 2 | W | I | M | T | P | S | T | L | A | P | 9 | 10009 |
| 3 | I | M | T | P | S | T | L | A | P | L | 8 | 10010' |

TABLE XXXIX

| Pos | 1 | 2 | 3 | 4 | 5 | 6 | 7 | 8 | 9 | 0 | score | SEQ. ID NO. |
|---|---|---|---|---|---|---|---|---|---|---|---|---|
| \multicolumn{12}{c}{184P1E2 v.1: HLA Peptide Scoring Results A3 10-mers SYFPEITHI} | |
| 445 | V | V | R | D | F | L | H | A | Q | K | 30 | 10011 |
| 228 | H | V | L | G | Q | D | K | V | S | Y | 26 | 10012 |
| 649 | N | V | C | R | K | P | F | S | F | K | 26 | 10013 |
| 565 | D | I | I | D | I | P | Q | L | F | K | 25 | 10014 |
| 102 | P | L | P | L | A | Y | A | V | L | Y | 24 | 10015 |
| 488 | M | L | L | A | S | P | G | A | C | F | 24 | 10016 |
| 489 | L | L | A | S | P | G | A | C | F | K | 24 | 10017 |
| 586 | D | L | V | N | M | L | V | L | G | K | 24 | 10018 |
| 41 | E | V | Y | G | T | P | G | V | D | I | 23 | 10019 |
| 353 | E | L | G | Y | V | Q | A | P | H | K | 23 | 10020 |
| 592 | V | L | G | K | H | L | G | I | P | K | 23 | 10021 |
| 312 | V | R | N | N | T | C | F | V | D | 22 | 10022 |
| 384 | I | L | G | P | D | F | G | V | Y | T | 22 | 10023 |
| 547 | C | I | D | W | N | R | E | V | L | K | 22 | 10024 |
| 2 | S | L | Q | R | I | V | R | V | S | L | 21 | 10025 |
| 25 | T | L | V | D | I | Y | G | S | V | P | 21 | 10026 |
| 192 | A | L | F | D | D | H | K | L | V | L | 21 | 10027 |
| 200 | V | L | H | T | S | S | Y | D | A | K | 21 | 10028 |
| 324 | A | E | L | A | R | K | A | G | C | K | 21 | 10029 |
| 554 | V | L | K | R | E | L | G | L | A | E | 21 | 10030 |
| 19 | C | V | A | G | V | T | F | L | V | D | 20 | 10031 |
| 91 | H | V | Q | I | S | Y | H | S | S | H | 20 | 10032 |
| 241 | R | L | H | G | D | E | E | R | F | F | 20 | 10033 |
| 319 | F | V | D | A | V | A | E | L | A | R | 20 | 10034 |
| 619 | S | L | L | E | P | L | G | H | C | D | 20 | 10035 |
| 8 | R | V | S | L | E | H | P | T | S | A | 19 | 10036 |
| 108 | A | V | L | Y | L | T | C | V | D | I | 19 | 10037 |
| 183 | M | V | L | R | T | Q | G | P | A | A | 19 | 10038 |
| 225 | A | V | R | H | V | L | G | Q | D | K | 19 | 10039 |
| 292 | R | V | A | P | W | I | M | T | P | S | 19 | 10040 |
| 409 | N | L | E | V | S | P | P | V | V | A | 19 | 10041 |
| 438 | S | G | R | R | V | T | Q | V | V | R | 19 | 10042 |
| 454 | K | V | Q | P | V | E | L | F | V | D | 19 | 10043 |
| 477 | F | V | P | A | P | D | G | K | G | F | 19 | 10044 |
| 511 | A | L | F | Q | G | V | V | D | D | D | 19 | 10045 |
| 526 | I | S | I | N | Q | V | L | S | N | K | 19 | 10046 |
| 10 | S | L | E | H | P | T | S | A | V | C | 18 | 10047 |
| 49 | D | I | Y | I | S | P | N | M | E | R | 18 | 10048 |
| 184 | V | L | R | T | Q | G | P | A | A | L | 18 | 10049 |
| 234 | K | V | S | Y | E | V | P | R | L | H | 18 | 10050 |
| 305 | P | L | E | V | Y | V | C | R | V | V | 18 | 10051 |
| 347 | W | I | Q | D | E | M | E | L | G | Y | 18 | 10052 |
| 427 | R | I | L | I | G | G | N | L | P | G | 18 | 10053 |
| 510 | R | A | L | L | F | Q | G | V | V | D | 18 | 10054 |
| 536 | D | L | I | N | Y | K | N | F | V | Q | 18 | 10055 |
| 643 | E | V | H | C | G | T | N | V | C | R | 18 | 10056 |

TABLE XXXIX-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 17 | A | V | C | V | A | G | V | E | T | L | 17 | 10057 |
| 198 | K | L | V | L | H | T | S | S | Y | D | 17 | 10058 |
| 270 | T | L | L | D | D | S | N | E | D | F | 17 | 10059 |
| 302 | T | L | P | P | L | E | V | Y | V | C | 17 | 10060 |
| 309 | Y | V | C | R | V | R | N | N | T | C | 17 | 10061 |
| 322 | A | V | A | E | L | A | R | K | A | G | 17 | 10062 |
| 325 | E | L | A | R | K | A | G | C | K | L | 17 | 10063 |
| 333 | K | L | T | I | C | P | Q | A | E | N | 17 | 10064 |
| 363 | T | L | P | V | V | F | D | S | P | R | 17 | 10065 |
| 383 | R | I | L | G | P | D | F | G | Y | V | 17 | 10066 |
| 428 | I | L | I | G | G | N | L | P | G | S | 17 | 10067 |
| 460 | E | L | F | V | D | W | L | A | V | G | 17 | 10068 |
| 530 | Q | V | L | S | N | K | D | L | I | N | 17 | 10069 |
| 531 | V | L | S | N | K | D | L | I | N | Y | 17 | 10070 |
| 77 | I | V | V | M | N | S | P | S | N | D | 16 | 10071 |
| 176 | D | L | E | D | M | S | V | M | V | L | 16 | 10072 |
| 221 | D | V | C | E | A | Y | R | H | V | L | 16 | 10073 |
| 238 | E | V | P | R | L | H | G | D | E | E | 16 | 10074 |
| 282 | S | P | I | F | T | D | T | V | V | F | 16 | 10075 |
| 283 | P | I | F | T | D | T | V | V | F | R | 16 | 10076 |
| 359 | A | P | H | K | T | L | P | V | V | F | 16 | 10077 |
| 411 | E | V | S | P | P | V | V | A | N | G | 16 | 10078 |
| 412 | V | S | P | P | V | V | A | N | G | K | 16 | 10079 |
| 444 | Q | V | V | R | D | F | L | H | A | Q | 16 | 10080 |
| 515 | Q | G | V | V | D | D | E | Q | V | K | 16 | 10081 |
| 522 | Q | V | K | T | I | S | I | N | Q | V | 16 | 10082 |
| 616 | K | V | R | S | L | L | E | P | L | G | 16 | 10083 |
| 5 | R | I | V | R | V | S | L | E | H | P | 15 | 10084 |
| 6 | I | V | R | V | S | L | E | H | P | T | 15 | 10085 |
| 26 | L | V | D | I | Y | G | S | V | P | E | 15 | 10086 |
| 28 | D | I | Y | G | S | V | P | E | G | T | 15 | 10087 |
| 51 | Y | I | S | P | N | M | E | R | G | R | 15 | 10088 |
| 60 | R | E | R | A | D | T | R | R | W | R | 15 | 10089 |
| 109 | V | L | Y | L | T | C | V | D | I | S | 15 | 10090 |
| 122 | D | L | N | C | E | G | R | Q | D | R | 15 | 10091 |
| 127 | G | R | Q | D | R | N | F | V | D | K | 15 | 10092 |
| 133 | F | V | D | K | R | Q | W | V | W | G | 15 | 10093 |
| 139 | W | V | W | G | P | S | S | G | Y | G | 15 | 10094 |
| 212 | Q | V | F | H | I | C | G | P | E | D | 15 | 10095 |
| 433 | N | L | P | G | S | S | G | R | R | V | 15 | 10096 |
| 441 | R | V | T | Q | V | V | R | D | F | L | 15 | 10097 |
| 465 | W | L | A | V | G | H | V | D | E | F | 15 | 10098 |
| 470 | H | V | D | E | F | L | S | F | V | P | 15 | 10099 |
| 496 | C | F | K | L | F | Q | E | K | Q | K | 15 | 10100 |
| 516 | G | V | V | D | D | E | Q | V | K | T | 15 | 10101 |
| 517 | V | V | D | D | E | Q | V | K | T | I | 15 | 10102 |
| 537 | L | I | N | Y | N | K | F | V | Q | S | 15 | 10103 |
| 574 | K | T | E | R | K | K | A | T | A | F | 15 | 10104 |
| 587 | L | V | N | M | L | V | L | G | K | H | 15 | 10105 |
| 591 | L | V | L | G | K | H | L | G | I | P | 15 | 10106 |
| 606 | I | I | N | G | C | C | L | L | E | E | 15 | 10107 |
| 612 | C | L | E | E | K | V | R | S | L | L | 15 | 10108 |
| 57 | E | R | G | R | E | R | A | D | T | R | 14 | 10109 |
| 75 | E | I | I | V | V | M | N | S | P | S | 14 | 10110 |
| 137 | R | Q | W | V | W | G | P | S | G | Y | 14 | 10111 |
| 144 | S | G | Y | G | G | I | L | L | V | N | 14 | 10112 |
| 149 | I | L | L | V | N | C | D | R | D | D | 14 | 10113 |
| 156 | R | D | D | P | S | C | D | V | Q | L | 14 | 10114 |
| 173 | C | L | Q | D | L | E | D | M | S | V | 14 | 10115 |
| 205 | S | Y | D | A | K | R | A | Q | V | F | 14 | 10116 |
| 215 | H | I | C | G | P | E | D | V | C | E | 14 | 10117 |
| 253 | G | L | S | F | P | D | A | G | F | T | 14 | 10118 |
| 263 | G | L | I | S | F | H | V | T | L | L | 14 | 10119 |
| 268 | H | V | T | L | L | D | D | S | N | E | 14 | 10120 |
| 288 | T | V | V | F | R | V | A | P | W | I | 14 | 10121 |
| 289 | V | V | F | R | V | A | P | W | I | M | 14 | 10122 |
| 307 | E | V | Y | C | R | V | R | N | N | T | 14 | 10123 |
| 320 | V | D | A | V | A | E | L | A | R | K | 14 | 10124 |
| 391 | Y | V | T | R | E | P | R | D | R | S | 14 | 10125 |
| 424 | P | L | G | R | I | L | I | G | G | N | 14 | 10126 |
| 429 | L | I | G | G | N | L | P | G | S | S | 14 | 10127 |
| 525 | T | I | S | I | N | Q | V | L | S | N | 14 | 10128 |
| 543 | F | V | Q | S | C | I | D | W | N | R | 14 | 10129 |
| 590 | M | L | V | L | G | K | H | L | G | I | 14 | 10130 |
| 625 | G | L | H | C | T | F | I | D | D | F | 14 | 10131 |
| 32 | S | V | P | E | G | T | E | M | F | E | 13 | 10132 |
| 58 | R | G | R | E | R | A | D | T | R | R | 13 | 10133 |
| 98 | S | S | H | E | P | L | P | L | A | Y | 13 | 10134 |
| 105 | L | A | Y | A | V | L | Y | L | T | C | 13 | 10135 |
| 111 | Y | L | T | C | V | D | I | S | L | D | 13 | 10136 |
| 170 | H | V | H | C | L | Q | D | L | E | D | 13 | 10137 |
| 189 | G | P | A | A | L | F | D | D | H | K | 13 | 10138 |
| 197 | H | K | L | V | L | H | T | S | S | Y | 13 | 10139 |
| 204 | S | S | Y | D | A | K | R | A | Q | V | 13 | 10140 |
| 229 | V | L | G | Q | D | K | V | S | Y | E | 13 | 10141 |
| 327 | A | R | K | A | G | C | K | L | T | I | 13 | 10142 |
| 356 | Y | V | Q | A | P | H | K | T | L | P | 13 | 10143 |
| 382 | K | R | I | L | G | P | D | F | G | Y | 13 | 10144 |
| 385 | L | G | P | D | F | G | Y | V | T | R | 13 | 10145 |
| 394 | R | E | P | R | D | R | S | V | S | G | 13 | 10146 |
| 397 | R | D | R | S | V | S | G | L | D | S | 13 | 10147 |
| 400 | S | V | S | G | L | D | S | F | G | N | 13 | 10148 |
| 403 | G | L | D | S | F | G | N | L | E | V | 13 | 10149 |
| 467 | A | V | G | H | V | D | E | F | L | S | 13 | 10150 |
| 474 | F | L | S | F | V | P | A | P | D | G | 13 | 10151 |
| 498 | K | L | F | Q | E | K | Q | K | C | G | 13 | 10152 |
| 505 | K | C | G | H | G | R | A | L | L | F | 13 | 10153 |
| 533 | S | N | K | D | L | I | N | Y | N | K | 13 | 10154 |
| 553 | E | V | L | K | R | E | L | G | L | A | 13 | 10155 |
| 568 | D | I | P | Q | L | F | K | T | E | R | 13 | 10156 |
| 569 | I | P | Q | L | F | K | T | E | R | K | 13 | 10157 |
| 571 | Q | L | F | K | T | E | R | K | K | A | 13 | 10158 |
| 620 | L | L | E | P | L | G | L | H | C | T | 13 | 10159 |
| 4 | Q | R | I | V | R | V | S | L | E | H | 12 | 10160 |
| 73 | T | L | E | I | I | V | V | M | N | S | 12 | 10161 |
| 76 | I | I | V | V | M | N | S | P | S | N | 12 | 10162 |
| 101 | E | P | L | P | L | A | Y | A | V | L | 12 | 10163 |
| 116 | D | I | S | L | D | C | D | L | N | C | 12 | 10164 |
| 150 | L | L | V | N | C | D | R | D | D | P | 12 | 10165 |
| 186 | R | T | Q | G | P | A | A | L | F | D | 12 | 10166 |
| 199 | L | V | L | H | T | S | S | Y | D | A | 12 | 10167 |
| 247 | E | R | F | F | V | E | G | L | S | F | 12 | 10168 |
| 250 | F | V | E | G | L | S | F | P | D | A | 12 | 10169 |
| 294 | A | P | W | I | M | T | P | S | T | L | 12 | 10170 |
| 366 | V | V | F | D | S | P | R | N | G | E | 12 | 10171 |
| 415 | P | V | V | A | N | G | K | E | Y | P | 12 | 10172 |
| 416 | V | V | A | N | G | K | E | Y | P | L | 12 | 10173 |
| 449 | L | H | A | Q | K | V | Q | P | P | P | 12 | 10174 |
| 461 | L | F | V | D | W | L | A | V | G | H | 12 | 10175 |
| 560 | G | L | A | E | C | D | I | I | D | I | 12 | 10176 |
| 567 | I | D | I | P | Q | L | F | K | T | E | 12 | 10177 |
| 570 | P | Q | L | F | K | T | E | R | K | K | 12 | 10178 |
| 596 | H | L | G | I | P | K | P | F | G | P | 12 | 10179 |
| 605 | P | I | I | N | G | C | C | C | L | E | 12 | 10180 |
| 607 | I | N | G | C | C | C | L | E | E | K | 12 | 10181 |
| 618 | R | S | L | L | E | P | L | G | L | H | 12 | 10182 |
| 639 | M | L | H | G | E | T | V | H | C | G | 12 | 10183 |
| 644 | V | H | C | G | T | N | V | C | R | K | 12 | 10184 |
| 47 | G | V | D | I | Y | I | S | P | N | M | 11 | 10185 |
| 66 | R | R | W | R | F | D | A | T | L | E | 11 | 10186 |
| 72 | A | T | L | E | I | I | V | V | M | N | 11 | 10187 |
| 78 | V | V | M | N | S | P | S | N | D | L | 11 | 10188 |
| 86 | D | L | N | D | S | H | V | Q | I | S | 11 | 10189 |
| 104 | P | L | A | Y | A | V | L | Y | L | T | 11 | 10190 |
| 114 | C | V | D | I | S | L | D | C | D | L | 11 | 10191 |
| 118 | S | L | D | C | D | L | N | C | E | G | 11 | 10192 |
| 128 | R | Q | D | R | N | F | V | D | K | R | 11 | 10193 |
| 148 | G | I | L | L | V | N | C | D | R | D | 11 | 10194 |
| 162 | D | V | Q | D | N | C | Q | D | H | V | 11 | 10195 |
| 181 | S | V | M | V | L | R | T | Q | G | P | 11 | 10196 |
| 224 | E | A | Y | R | H | V | L | G | Q | D | 11 | 10197 |
| 232 | Q | D | K | V | S | Y | E | V | P | R | 11 | 10198 |
| 262 | T | G | I | S | F | H | V | T | L | L | 11 | 10199 |
| 264 | G | I | S | F | H | V | T | L | L | D | 11 | 10200 |
| 271 | L | L | D | D | S | N | E | D | F | S | 11 | 10201 |
| 296 | W | I | M | T | P | S | T | L | P | P | 11 | 10202 |
| 300 | P | S | T | L | P | P | L | E | V | Y | 11 | 10203 |
| 335 | T | I | C | P | Q | A | E | N | R | N | 11 | 10204 |
| 352 | M | E | L | G | Y | V | Q | A | P | H | 11 | 10205 |
| 365 | P | V | V | F | D | S | P | R | N | G | 11 | 10206 |
| 372 | R | N | G | E | L | Q | D | F | P | Y | 11 | 10207 |
| 373 | N | G | E | L | Q | D | F | P | Y | K | 11 | 10208 |

TABLE XXXIX-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 375 | E | L | Q | D | F | P | Y | K | R | I | 11 | 10209 |
| 380 | P | Y | K | R | I | L | G | P | D | F | 11 | 10210 |
| 393 | T | R | E | P | R | D | R | S | V | S | 11 | 10211 |
| 418 | A | N | G | K | E | Y | P | L | G | R | 11 | 10212 |
| 421 | K | E | Y | P | L | G | R | I | L | I | 11 | 10213 |
| 430 | I | G | G | N | L | P | G | S | S | G | 11 | 10214 |
| 458 | P | V | E | L | F | V | D | W | L | A | 11 | 10215 |
| 462 | F | V | D | W | L | A | V | G | H | V | 11 | 10216 |
| 475 | L | S | F | V | P | A | P | D | G | K | 11 | 10217 |
| 484 | K | G | F | R | M | L | L | A | S | P | 11 | 10218 |
| 558 | E | L | G | L | A | E | C | D | I | I | 11 | 10219 |
| 566 | I | I | D | I | P | Q | L | F | K | T | 11 | 10220 |
| 580 | A | T | A | F | F | P | D | L | V | N | 11 | 10221 |
| 598 | G | I | P | K | P | F | G | P | I | I | 11 | 10222 |
| 623 | P | L | G | L | H | C | T | F | I | D | 11 | 10223 |
| 636 | P | Y | H | M | L | H | G | E | V | H | 11 | 10224 |
| 11 | L | E | H | P | T | S | A | V | C | V | 10 | 10225 |
| 21 | A | G | V | E | T | L | V | D | I | Y | 10 | 10226 |
| 22 | G | V | E | T | L | V | D | I | Y | G | 10 | 10227 |
| 34 | P | E | G | T | E | M | F | E | V | Y | 10 | 10228 |
| 65 | T | R | R | W | R | F | D | A | T | L | 10 | 10229 |
| 67 | R | W | R | F | D | A | T | L | E | I | 10 | 10230 |
| 85 | N | D | L | N | D | S | H | V | Q | I | 10 | 10231 |
| 93 | Q | I | S | Y | H | S | S | H | E | P | 10 | 10232 |
| 151 | L | V | N | C | D | R | D | D | P | S | 10 | 10233 |
| 175 | Q | D | L | E | D | M | S | V | M | V | 10 | 10234 |
| 185 | L | R | T | Q | G | P | A | A | L | F | 10 | 10235 |
| 254 | L | S | F | P | D | A | G | F | T | G | 10 | 10236 |
| 259 | A | G | F | T | G | L | I | S | F | H | 10 | 10237 |
| 301 | S | T | L | P | P | L | E | V | Y | V | 10 | 10238 |
| 334 | L | T | I | C | P | Q | A | E | N | R | 10 | 10239 |
| 362 | K | T | L | P | V | V | F | D | S | P | 10 | 10240 |
| 432 | G | N | L | P | G | S | S | G | R | R | 10 | 10241 |
| 487 | R | M | L | L | A | S | P | G | A | C | 10 | 10242 |
| 494 | G | A | C | F | K | L | F | Q | E | K | 10 | 10243 |
| 501 | Q | E | K | Q | K | C | G | H | G | R | 10 | 10244 |
| 512 | L | L | F | Q | G | V | V | D | D | E | 10 | 10245 |
| 524 | K | T | I | S | I | N | Q | V | L | S | 10 | 10246 |
| 546 | S | C | I | D | W | N | R | E | V | L | 10 | 10247 |
| 548 | I | D | W | N | R | E | V | L | K | R | 10 | 10248 |
| 575 | T | E | R | K | K | A | T | A | F | F | 10 | 10249 |
| 630 | F | I | D | D | F | T | P | Y | H | M | 10 | 10250 |
| 15 | T | S | A | V | C | V | A | G | V | E | 9 | 10251 |
| 56 | M | E | R | G | R | E | R | A | D | T | 9 | 10252 |
| 71 | D | A | T | L | E | I | I | V | V | M | 9 | 10253 |
| 121 | C | D | L | N | C | E | G | R | Q | D | 9 | 10254 |
| 163 | V | Q | D | N | C | D | Q | H | V | H | 9 | 10255 |
| 193 | L | F | D | D | H | K | L | V | L | H | 9 | 10256 |
| 206 | Y | D | A | K | R | A | Q | V | F | H | 9 | 10257 |
| 227 | R | H | V | L | G | Q | D | K | V | S | 9 | 10258 |
| 235 | V | S | Y | E | V | P | R | L | H | G | 9 | 10259 |
| 252 | E | G | L | S | F | P | D | A | G | F | 9 | 10260 |
| 257 | P | D | A | G | F | T | G | L | I | S | 9 | 10261 |
| 281 | A | S | P | I | F | T | D | T | V | V | 9 | 10262 |
| 303 | L | P | P | L | E | V | Y | V | C | R | 9 | 10263 |
| 349 | Q | D | E | M | E | L | G | Y | V | Q | 9 | 10264 |
| 369 | D | S | P | R | N | G | E | L | Q | D | 9 | 10265 |
| 370 | S | P | R | N | G | E | L | Q | D | F | 9 | 10266 |
| 414 | P | P | V | V | A | N | G | K | E | Y | 9 | 10267 |
| 435 | P | G | S | S | G | R | R | V | T | Q | 9 | 10268 |
| 447 | R | D | F | L | H | A | Q | K | V | Q | 9 | 10269 |
| 448 | D | F | L | H | A | Q | K | V | Q | P | 9 | 10270 |
| 452 | A | Q | K | V | Q | P | P | V | E | L | 9 | 10271 |
| 468 | V | G | H | V | D | E | F | L | S | F | 9 | 10272 |
| 478 | V | P | A | P | D | G | K | G | F | R | 9 | 10273 |
| 485 | G | F | R | M | L | L | A | S | P | G | 9 | 10274 |
| 491 | A | S | P | G | A | C | F | K | L | F | 9 | 10275 |
| 527 | S | I | N | Q | V | L | S | N | K | D | 9 | 10276 |
| 538 | I | N | Y | N | K | F | V | Q | S | C | 9 | 10277 |
| 564 | C | D | I | I | D | I | P | Q | L | F | 9 | 10278 |
| 621 | L | E | P | L | G | L | H | C | T | F | 9 | 10279 |
| 16 | S | A | V | C | V | A | G | V | E | T | 8 | 10280 |
| 31 | G | S | V | P | E | G | T | E | M | F | 8 | 10281 |
| 53 | S | P | N | M | E | R | G | R | E | R | 8 | 10282 |
| 82 | S | P | S | N | D | L | N | D | S | H | 8 | 10283 |
| 87 | L | N | D | S | H | V | Q | I | S | Y | 8 | 10284 |
| 136 | K | R | Q | W | V | W | G | P | S | G | 8 | 10285 |
| 147 | G | G | I | L | L | V | N | C | D | R | 8 | 10286 |
| 174 | L | Q | D | L | E | D | M | S | V | M | 8 | 10287 |
| 177 | L | E | D | M | S | V | M | V | L | R | 8 | 10288 |
| 188 | Q | G | P | A | A | L | F | D | D | H | 8 | 10289 |
| 208 | A | K | R | A | Q | V | F | H | I | C | 8 | 10290 |
| 217 | C | G | P | E | D | V | C | E | A | Y | 8 | 10291 |
| 218 | G | P | E | D | V | C | E | A | Y | R | 8 | 10292 |
| 239 | V | P | R | L | H | G | D | E | E | R | 8 | 10293 |
| 275 | S | N | E | D | F | S | A | S | P | I | 8 | 10294 |
| 280 | S | A | S | P | I | F | T | D | T | V | 8 | 10295 |
| 310 | V | C | R | V | R | N | N | T | C | F | 8 | 10296 |
| 316 | N | T | C | F | V | D | A | V | A | E | 8 | 10297 |
| 328 | R | K | A | G | C | K | L | T | I | C | 8 | 10298 |
| 350 | D | E | M | E | L | G | Y | V | Q | A | 8 | 10299 |
| 405 | D | S | F | G | N | L | E | V | S | P | 8 | 10300 |
| 408 | G | N | L | E | V | S | P | V | V | V | 8 | 10301 |
| 425 | L | G | R | I | L | I | G | G | N | L | 8 | 10302 |
| 431 | G | G | N | L | P | G | S | S | G | R | 8 | 10303 |
| 437 | S | S | G | R | R | V | T | Q | V | V | 8 | 10304 |
| 440 | R | R | V | T | Q | V | V | R | D | F | 8 | 10305 |
| 463 | V | D | W | L | A | V | G | H | V | D | 8 | 10306 |
| 464 | D | W | L | A | V | G | H | V | D | E | 8 | 10307 |
| 503 | K | Q | K | C | G | H | G | R | A | L | 8 | 10308 |
| 504 | Q | K | C | G | H | G | R | A | L | L | 8 | 10309 |
| 552 | R | E | V | L | K | R | E | L | G | L | 8 | 10310 |
| 557 | R | E | L | G | L | A | E | C | D | I | 8 | 10311 |
| 573 | F | K | T | E | R | K | K | A | T | A | 8 | 10312 |
| 584 | F | P | D | L | V | N | M | L | V | L | 8 | 10313 |
| 609 | G | C | C | C | L | E | E | K | V | R | 8 | 10314 |
| 628 | C | T | F | I | D | D | F | T | P | Y | 8 | 10315 |
| 629 | T | F | I | D | D | F | T | P | Y | H | 8 | 10316 |
| 3 | L | Q | R | I | V | R | V | S | L | E | 7 | 10317 |
| 9 | V | S | L | E | H | P | T | S | A | V | 7 | 10318 |
| 29 | I | Y | G | S | V | P | E | G | T | E | 7 | 10319 |
| 61 | E | R | A | D | T | R | R | W | R | F | 7 | 10320 |
| 63 | A | D | T | R | R | W | R | F | D | A | 7 | 10321 |
| 64 | D | T | R | R | W | R | F | D | A | T | 7 | 10322 |
| 88 | N | D | S | H | V | Q | I | S | Y | H | 7 | 10323 |
| 99 | S | H | E | P | L | P | L | A | Y | A | 7 | 10324 |
| 103 | L | P | L | A | Y | A | V | L | Y | L | 7 | 10325 |
| 126 | E | G | R | Q | D | R | N | F | V | D | 7 | 10326 |
| 153 | N | C | D | R | D | D | P | S | C | D | 7 | 10327 |
| 161 | C | D | V | Q | D | N | C | D | Q | H | 7 | 10328 |
| 201 | L | H | T | S | S | Y | D | A | K | R | 7 | 10329 |
| 214 | F | H | I | C | G | P | E | D | V | C | 7 | 10330 |
| 219 | P | E | D | V | C | E | A | Y | R | H | 7 | 10331 |
| 248 | R | F | F | V | E | G | L | S | F | P | 7 | 10332 |
| 291 | F | R | V | A | P | W | I | M | T | P | 7 | 10333 |
| 315 | N | N | T | C | F | V | D | A | V | A | 7 | 10334 |
| 337 | C | P | Q | A | E | N | R | N | D | R | 7 | 10335 |
| 340 | A | E | N | R | N | D | R | W | I | Q | 7 | 10336 |
| 341 | E | N | R | N | D | R | W | I | Q | D | 7 | 10337 |
| 343 | R | N | D | R | W | I | Q | D | E | M | 7 | 10338 |
| 346 | R | W | I | Q | D | E | M | E | L | G | 7 | 10339 |
| 357 | V | Q | A | P | H | K | T | L | P | V | 7 | 10340 |
| 374 | G | E | L | Q | D | F | P | Y | K | R | 7 | 10341 |
| 395 | E | P | R | D | R | S | V | S | G | L | 7 | 10342 |
| 399 | R | S | V | S | G | L | D | S | F | G | 7 | 10343 |
| 402 | S | G | L | D | S | F | G | N | L | E | 7 | 10344 |
| 426 | G | R | I | L | I | G | G | N | L | P | 7 | 10345 |
| 439 | G | R | R | V | T | Q | V | V | R | D | 7 | 10346 |
| 455 | V | Q | P | P | V | E | L | F | V | D | 7 | 10347 |
| 509 | G | R | A | L | L | F | Q | G | V | V | 7 | 10348 |
| 555 | L | K | R | E | L | G | L | A | E | C | 7 | 10349 |
| 556 | K | R | E | L | G | L | A | E | C | D | 7 | 10350 |
| 577 | R | K | K | A | T | A | F | F | P | D | 7 | 10351 |
| 582 | A | F | F | P | D | L | V | N | M | L | 7 | 10352 |
| 595 | K | H | L | G | I | P | K | P | F | G | 7 | 10353 |
| 597 | L | G | I | P | K | P | F | G | P | I | 7 | 10354 |
| 599 | I | P | K | P | F | G | P | I | I | N | 7 | 10355 |
| 648 | T | N | V | C | R | K | P | F | S | F | 7 | 10356 |
| 1 | M | S | L | Q | R | I | V | R | V | S | 6 | 10357 |
| 40 | F | E | V | Y | G | T | P | G | V | D | 6 | 10358 |
| 42 | V | Y | G | T | P | G | V | D | I | Y | 6 | 10359 |
| 69 | R | F | D | A | T | L | E | I | I | V | 6 | 10360 |

TABLE XXXIX-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 74 | L | E | I | I | V | V | M | N | S | P | 6 | 10361 |
| 80 | M | N | S | P | S | N | D | L | N | D | 6 | 10362 |
| 84 | S | N | D | L | N | D | S | H | V | Q | 6 | 10363 |
| 92 | V | Q | I | S | Y | H | S | S | H | E | 6 | 10364 |
| 94 | I | S | Y | H | S | S | H | E | P | L | 6 | 10365 |
| 124 | N | C | E | G | R | Q | D | R | N | F | 6 | 10366 |
| 129 | Q | D | R | N | F | V | D | K | R | Q | 6 | 10367 |
| 131 | R | N | F | V | D | K | R | Q | W | V | 6 | 10368 |
| 145 | G | Y | G | G | I | L | L | V | N | C | 6 | 10369 |
| 164 | Q | D | N | C | D | Q | H | V | H | C | 6 | 10370 |
| 167 | C | D | Q | H | V | H | C | L | Q | D | 6 | 10371 |
| 222 | V | C | E | A | Y | R | H | V | L | G | 6 | 10372 |
| 240 | P | R | L | H | G | D | E | E | R | F | 6 | 10373 |
| 258 | D | A | G | F | T | G | L | I | S | F | 6 | 10374 |
| 274 | D | S | N | E | D | F | S | A | S | P | 6 | 10375 |
| 278 | D | F | S | A | S | P | I | F | T | D | 6 | 10376 |
| 286 | T | D | T | V | V | F | R | V | A | P | 6 | 10377 |
| 358 | Q | A | P | H | K | T | L | P | V | V | 6 | 10378 |
| 368 | F | D | S | P | R | N | G | E | L | Q | 6 | 10379 |
| 377 | Q | D | F | P | Y | K | R | I | L | G | 6 | 10380 |
| 392 | V | T | R | E | P | R | D | R | S | V | 6 | 10381 |
| 398 | D | R | S | V | S | G | L | D | S | F | 6 | 10382 |
| 436 | G | S | S | G | R | R | V | T | Q | V | 6 | 10383 |
| 453 | Q | K | V | Q | P | P | V | E | L | F | 6 | 10384 |
| 456 | Q | P | P | V | E | L | F | V | D | W | 6 | 10385 |
| 459 | V | E | L | F | V | D | W | L | A | V | 6 | 10386 |
| 473 | E | F | L | S | F | V | P | A | P | D | 6 | 10387 |
| 480 | A | P | D | G | K | G | F | R | M | L | 6 | 10388 |
| 482 | D | G | K | G | F | R | M | L | L | A | 6 | 10389 |
| 492 | S | P | G | A | C | F | K | L | F | Q | 6 | 10390 |
| 507 | G | H | G | R | A | L | L | F | Q | G | 6 | 10391 |
| 535 | K | D | L | I | N | Y | N | K | F | V | 6 | 10392 |
| 579 | K | A | T | A | F | F | P | D | L | V | 6 | 10393 |
| 585 | P | D | L | V | N | M | L | V | L | G | 6 | 10394 |
| 594 | G | K | H | L | G | I | P | K | P | F | 6 | 10395 |
| 633 | D | F | T | P | Y | H | M | L | H | G | 6 | 10396 |
| 640 | L | H | G | E | V | H | C | G | T | N | 6 | 10397 |
| 646 | C | G | T | N | V | C | R | K | P | F | 6 | 10398 |
| 13 | H | P | T | S | A | V | C | V | A | G | 5 | 10399 |
| 14 | P | T | S | A | V | C | V | A | G | V | 5 | 10400 |
| 24 | E | T | L | V | D | I | Y | G | S | V | 5 | 10401 |
| 35 | E | G | T | E | M | F | E | V | Y | G | 5 | 10402 |
| 37 | T | E | M | F | E | V | Y | G | T | P | 5 | 10403 |
| 38 | E | M | F | E | V | Y | G | T | P | G | 5 | 10404 |
| 48 | V | D | I | Y | I | S | P | N | M | E | 5 | 10405 |
| 50 | I | Y | I | S | P | N | M | E | R | G | 5 | 10406 |
| 52 | I | S | P | N | M | E | R | G | R | E | 5 | 10407 |
| 70 | F | D | A | T | L | E | I | I | V | V | 5 | 10408 |
| 100 | H | E | P | L | P | L | A | Y | A | V | 5 | 10409 |
| 106 | A | Y | A | V | L | Y | L | T | C | V | 5 | 10410 |
| 107 | Y | A | V | L | Y | L | T | C | V | D | 5 | 10411 |
| 117 | I | S | L | D | C | D | L | N | C | E | 5 | 10412 |
| 119 | L | D | C | D | L | N | C | E | G | R | 5 | 10413 |
| 132 | N | F | V | D | K | R | Q | W | V | W | 5 | 10414 |
| 142 | G | P | S | G | Y | G | G | I | L | L | 5 | 10415 |
| 155 | D | R | D | D | P | S | C | D | V | Q | 5 | 10416 |
| 180 | M | S | V | M | V | L | R | T | Q | G | 5 | 10417 |
| 191 | A | L | L | F | D | D | H | K | L | V | 5 | 10418 |
| 196 | D | H | K | L | V | L | H | T | S | S | 5 | 10419 |
| 216 | I | C | G | P | E | D | V | C | E | A | 5 | 10420 |
| 243 | H | G | D | E | E | R | F | F | V | E | 5 | 10421 |
| 244 | G | D | E | E | R | F | F | V | E | G | 5 | 10422 |
| 261 | F | T | G | L | I | S | F | H | V | T | 5 | 10423 |
| 265 | I | S | F | H | V | T | F | L | L | D | 5 | 10424 |
| 273 | D | D | S | N | E | D | F | S | A | S | 5 | 10425 |
| 297 | I | M | T | P | S | T | L | P | P | L | 5 | 10426 |
| 306 | L | E | V | Y | V | C | R | V | R | N | 5 | 10427 |
| 313 | V | R | N | N | T | C | F | V | D | A | 5 | 10428 |
| 314 | R | N | N | T | C | F | V | D | A | V | 5 | 10429 |
| 321 | D | A | V | A | E | L | A | R | K | A | 5 | 10430 |
| 331 | G | C | K | L | T | I | C | P | Q | A | 5 | 10431 |
| 354 | L | G | Y | V | Q | A | P | H | K | T | 5 | 10432 |
| 360 | P | H | K | T | L | P | V | V | F | D | 5 | 10433 |
| 379 | F | P | Y | K | R | I | L | G | P | D | 5 | 10434 |
| 381 | Y | K | R | I | L | G | P | D | F | G | 5 | 10435 |
| 388 | D | F | G | Y | V | T | R | E | P | R | 5 | 10436 |
| 390 | G | Y | V | T | R | E | P | R | D | R | 5 | 10437 |
| 406 | S | F | G | N | L | E | V | S | P | P | 5 | 10438 |
| 410 | L | E | V | S | P | P | V | V | A | N | 5 | 10439 |
| 434 | L | P | G | S | S | G | R | R | V | T | 5 | 10440 |
| 451 | H | A | Q | K | V | Q | P | P | V | E | 5 | 10441 |
| 476 | S | F | V | P | A | P | D | G | K | G | 5 | 10442 |
| 499 | L | F | Q | E | K | Q | K | C | G | H | 5 | 10443 |
| 506 | C | G | H | G | R | A | L | L | F | Q | 5 | 10444 |
| 508 | H | G | R | A | L | L | F | Q | G | V | 5 | 10445 |
| 523 | V | K | T | I | S | I | N | Q | V | L | 5 | 10446 |
| 534 | N | K | D | L | I | N | Y | N | K | F | 5 | 10447 |
| 601 | K | P | F | G | P | I | I | N | G | C | 5 | 10448 |
| 610 | C | C | C | L | E | E | K | V | R | S | 5 | 10449 |
| 611 | C | C | L | E | E | K | V | R | S | L | 5 | 10450 |
| 617 | V | R | S | L | L | E | P | L | G | L | 5 | 10451 |
| 622 | E | P | L | G | L | H | C | T | F | I | 5 | 10452 |
| 632 | D | D | F | T | P | Y | H | M | L | H | 5 | 10453 |
| 635 | T | P | Y | H | M | L | H | G | E | V | 5 | 10454 |
| 637 | Y | H | M | L | H | G | E | V | H | C | 5 | 10455 |
| 651 | C | R | K | P | F | S | F | K | W | W | 5 | 10456 |
| 652 | R | K | P | F | S | F | K | W | W | N | 5 | 10457 |
| 655 | F | S | F | K | W | W | N | M | V | P | 5 | 10458 |
| 7 | V | R | V | S | L | E | H | P | T | S | 4 | 10459 |
| 12 | E | H | P | T | S | A | V | C | V | A | 4 | 10460 |
| 20 | V | A | G | V | E | T | L | V | D | I | 4 | 10461 |
| 30 | Y | G | S | V | P | E | G | T | E | M | 4 | 10462 |
| 46 | P | G | V | D | I | Y | I | S | P | N | 4 | 10463 |
| 55 | N | M | E | R | G | R | E | R | A | D | 4 | 10464 |
| 62 | R | A | D | T | R | R | W | R | F | D | 4 | 10465 |
| 83 | P | S | N | D | L | N | D | S | H | V | 4 | 10466 |
| 96 | Y | H | S | S | H | E | P | L | P | L | 4 | 10467 |
| 110 | L | Y | L | T | C | V | D | I | S | L | 4 | 10468 |
| 125 | C | E | G | R | Q | D | R | N | F | V | 4 | 10469 |
| 134 | V | D | K | R | Q | W | V | W | G | P | 4 | 10470 |
| 135 | D | K | R | Q | W | V | W | G | P | S | 4 | 10471 |
| 140 | V | W | G | P | S | G | Y | G | G | I | 4 | 10472 |
| 141 | W | G | P | S | G | Y | G | G | I | L | 4 | 10473 |
| 154 | C | D | R | D | D | P | S | C | D | V | 4 | 10474 |
| 179 | D | M | S | V | M | V | L | R | T | Q | 4 | 10475 |
| 195 | D | D | H | K | L | V | L | H | T | S | 4 | 10476 |
| 207 | D | A | K | R | A | Q | V | F | H | I | 4 | 10477 |
| 209 | K | R | A | Q | V | F | H | I | C | G | 4 | 10478 |
| 210 | R | A | Q | V | F | H | I | C | G | P | 4 | 10479 |
| 211 | A | Q | V | F | H | I | C | G | P | E | 4 | 10480 |
| 223 | C | E | A | Y | R | H | V | L | G | Q | 4 | 10481 |
| 231 | G | Q | D | K | V | S | Y | E | V | P | 4 | 10482 |
| 237 | Y | E | V | P | R | L | H | G | D | E | 4 | 10483 |
| 246 | E | R | F | F | V | E | G | L | S | 4 | 10484 |
| 276 | N | E | D | F | S | A | S | P | I | F | 4 | 10485 |
| 285 | F | T | D | T | V | V | F | R | V | A | 4 | 10486 |
| 290 | V | F | R | V | A | P | W | I | M | T | 4 | 10487 |
| 295 | P | W | I | M | T | P | S | T | L | P | 4 | 10488 |
| 299 | T | P | S | T | L | P | P | L | E | V | 4 | 10489 |
| 318 | C | F | V | D | A | V | A | E | L | A | 4 | 10490 |
| 323 | V | A | E | L | A | R | K | A | G | C | 4 | 10491 |
| 332 | C | K | L | T | I | C | P | Q | A | 4 | 10492 |
| 339 | Q | A | E | N | R | N | D | R | W | I | 4 | 10493 |
| 344 | N | D | R | W | I | Q | D | E | M | E | 4 | 10494 |
| 348 | I | Q | D | E | M | E | L | G | Y | V | 4 | 10495 |
| 355 | G | Y | V | Q | A | P | H | K | T | L | 4 | 10496 |
| 389 | F | G | Y | V | T | R | E | P | R | D | 4 | 10497 |
| 396 | P | R | D | R | S | V | S | G | L | D | 4 | 10498 |
| 404 | L | D | F | S | F | G | N | L | E | V | 4 | 10499 |
| 422 | E | Y | P | L | G | R | I | L | I | G | 4 | 10500 |
| 423 | Y | P | L | G | R | I | L | I | G | G | 4 | 10501 |
| 442 | V | T | Q | V | V | R | D | F | L | H | 4 | 10502 |
| 469 | G | H | V | D | E | F | L | S | F | V | 4 | 10503 |
| 471 | V | D | E | F | L | S | F | V | P | A | 4 | 10504 |
| 479 | P | A | P | D | G | K | G | F | R | M | 4 | 10505 |
| 483 | G | K | G | F | R | M | L | L | A | S | 4 | 10506 |
| 493 | P | G | A | C | F | K | L | F | Q | E | 4 | 10507 |
| 542 | K | F | V | Q | S | C | I | D | W | N | 4 | 10508 |
| 550 | W | N | R | E | V | L | K | R | E | L | 4 | 10509 |
| 559 | L | G | L | A | E | C | D | I | I | D | 4 | 10510 |
| 562 | A | E | C | D | I | I | D | I | P | Q | 4 | 10511 |
| 563 | E | C | D | I | I | D | I | P | Q | L | 4 | 10512 |

TABLE XXXIX-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 576 | E | R | K | K | A | T | A | F | F | P | 4 | 10513 |
| 578 | K | K | A | T | A | F | F | P | D | L | 4 | 10514 |
| 581 | T | A | F | F | P | D | L | V | N | M | 4 | 10515 |
| 588 | V | N | M | L | V | L | G | K | H | L | 4 | 10516 |
| 602 | P | F | G | P | I | I | N | G | C | C | 4 | 10517 |
| 603 | F | G | P | I | I | N | G | C | C | C | 4 | 10518 |
| 604 | G | P | I | I | N | G | C | C | C | L | 4 | 10519 |
| 614 | E | E | K | V | R | S | L | L | E | P | 4 | 10520 |
| 627 | H | C | T | F | I | D | D | F | T | P | 4 | 10521 |
| 641 | H | G | E | V | H | C | G | T | N | V | 4 | 10522 |
| 642 | G | E | V | H | C | G | T | N | V | C | 4 | 10523 |
| 18 | V | C | V | A | G | V | E | T | L | V | 3 | 10524 |
| 27 | V | D | I | Y | G | S | V | P | E | G | 3 | 10525 |
| 43 | Y | G | T | P | G | V | D | I | Y | I | 3 | 10526 |
| 59 | G | R | E | R | A | D | T | R | R | W | 3 | 10527 |
| 90 | S | H | V | Q | I | S | Y | H | S | S | 3 | 10528 |
| 112 | L | T | C | V | D | I | S | L | D | C | 3 | 10529 |
| 115 | V | D | I | S | L | D | C | D | L | N | 3 | 10530 |
| 130 | D | R | N | F | V | D | K | R | Q | W | 3 | 10531 |
| 138 | Q | W | V | W | G | P | S | G | Y | G | 3 | 10532 |
| 143 | P | S | G | Y | G | G | I | L | L | V | 3 | 10533 |
| 152 | V | N | C | D | R | D | P | S | C | 3 | 10534 |
| 172 | H | C | L | Q | D | L | E | D | M | S | 3 | 10535 |
| 178 | E | D | M | S | V | M | V | L | R | T | 3 | 10536 |
| 187 | T | Q | G | P | A | A | L | F | D | D | 3 | 10537 |
| 194 | F | D | D | H | K | L | V | L | H | T | 3 | 10538 |
| 202 | H | T | S | S | Y | D | A | K | R | A | 3 | 10539 |
| 245 | D | E | E | R | F | F | V | E | G | L | 3 | 10540 |
| 251 | V | E | G | L | S | F | P | D | A | G | 3 | 10541 |
| 255 | S | F | P | D | A | G | F | T | G | L | 3 | 10542 |
| 256 | F | P | D | A | G | F | T | G | L | I | 3 | 10543 |
| 269 | V | T | L | L | D | D | S | N | E | D | 3 | 10544 |
| 284 | I | F | T | D | T | V | V | F | R | V | 3 | 10545 |
| 287 | D | T | V | L | V | F | R | V | A | P | W | 3 | 10546 |
| 304 | P | P | L | E | V | Y | V | C | R | V | 3 | 10547 |
| 311 | C | R | V | R | N | N | T | C | F | V | 3 | 10548 |
| 317 | T | C | F | V | D | A | V | A | E | L | 3 | 10549 |
| 326 | L | A | R | K | A | G | C | K | L | T | 3 | 10550 |
| 329 | K | A | G | C | K | L | T | I | C | P | 3 | 10551 |
| 330 | A | G | C | K | L | T | I | C | P | Q | 3 | 10552 |
| 378 | D | F | P | Y | K | R | I | L | G | P | 3 | 10553 |
| 419 | N | G | K | E | Y | P | L | G | R | I | 3 | 10554 |
| 420 | G | K | E | Y | P | L | G | R | I | L | 3 | 10555 |
| 443 | T | Q | V | V | R | D | F | L | H | A | 3 | 10556 |
| 446 | V | R | D | F | L | H | A | Q | K | V | 3 | 10557 |
| 490 | L | A | S | P | G | A | C | F | K | L | 3 | 10558 |
| 495 | A | C | F | K | L | F | Q | E | K | Q | 3 | 10559 |
| 514 | F | Q | G | V | V | D | D | E | Q | V | 3 | 10560 |
| 520 | D | E | Q | V | K | T | I | S | I | N | 3 | 10561 |
| 539 | N | Y | N | K | F | V | Q | S | C | I | 3 | 10562 |
| 545 | Q | S | C | I | D | W | N | R | E | V | 3 | 10563 |
| 549 | D | W | N | R | E | V | L | K | R | E | 3 | 10564 |
| 613 | L | E | E | K | V | R | S | L | L | E | 3 | 10565 |
| 615 | E | K | V | R | S | L | L | E | P | L | 3 | 10566 |
| 631 | I | D | D | F | T | P | Y | H | M | L | 3 | 10567 |
| 650 | V | C | R | K | P | F | S | F | K | W | 3 | 10568 |
| 653 | K | P | F | S | F | K | W | W | N | M | 3 | 10569 |
| 33 | V | P | E | G | T | E | M | F | E | V | 2 | 10570 |
| 44 | G | T | P | G | V | D | I | Y | I | S | 2 | 10571 |
| 45 | T | P | G | V | D | I | Y | I | S | P | 2 | 10572 |
| 54 | P | N | M | E | R | G | R | E | R | A | 2 | 10573 |
| 120 | D | C | D | L | N | C | E | G | R | Q | 2 | 10574 |
| 169 | Q | H | V | H | C | L | Q | D | L | E | 2 | 10575 |
| 182 | V | M | V | L | R | T | Q | G | P | A | 2 | 10576 |
| 190 | P | A | A | L | F | D | D | H | K | L | 2 | 10577 |
| 213 | V | F | H | I | C | G | P | E | D | V | 2 | 10578 |
| 242 | L | H | G | D | E | E | R | F | F | V | 2 | 10579 |
| 260 | G | F | T | G | L | I | S | F | H | V | 2 | 10580 |
| 267 | F | H | V | T | L | L | D | D | S | N | 2 | 10581 |
| 272 | L | D | S | N | E | D | F | S | A | 2 | 10582 |
| 279 | F | S | A | S | P | I | F | T | D | T | 2 | 10583 |
| 293 | V | A | P | W | I | M | T | P | S | T | 2 | 10584 |
| 336 | I | C | P | Q | A | E | N | R | N | D | 2 | 10585 |
| 338 | P | Q | A | E | N | R | N | D | R | W | 2 | 10586 |
| 345 | D | R | W | I | Q | D | E | M | E | L | 2 | 10587 |
| 351 | E | M | E | L | G | Y | V | Q | A | P | 2 | 10588 |
| 371 | P | R | N | G | E | L | Q | D | F | P | 2 | 10589 |
| 387 | P | D | F | G | Y | V | T | R | E | P | 2 | 10590 |
| 401 | V | S | G | L | D | S | F | G | N | L | 2 | 10591 |
| 413 | S | P | P | V | V | A | N | G | K | E | 2 | 10592 |
| 417 | V | A | N | G | K | E | Y | P | L | G | 2 | 10593 |
| 457 | P | P | V | E | L | F | V | D | W | L | 2 | 10594 |
| 466 | L | A | V | G | H | V | D | E | F | L | 2 | 10595 |
| 472 | D | E | F | L | S | F | V | P | A | P | 2 | 10596 |
| 481 | P | D | G | K | G | F | R | M | L | L | 2 | 10597 |
| 497 | F | K | L | F | Q | E | K | Q | K | C | 2 | 10598 |
| 513 | L | F | Q | G | V | V | D | D | E | Q | 2 | 10599 |
| 518 | V | D | D | E | Q | V | K | T | I | S | 2 | 10600 |
| 519 | D | D | E | Q | V | K | T | I | S | I | 2 | 10601 |
| 528 | I | N | Q | V | L | S | N | K | D | L | 2 | 10602 |
| 572 | L | F | K | T | E | R | K | K | A | T | 2 | 10603 |
| 583 | F | F | P | D | L | V | N | M | L | V | 2 | 10604 |
| 589 | N | M | L | V | L | G | K | H | L | G | 2 | 10605 |
| 624 | L | G | L | H | C | T | F | I | D | D | 2 | 10606 |
| 638 | H | M | L | H | G | E | V | H | C | G | 2 | 10607 |
| 23 | V | E | T | L | V | D | I | Y | G | S | 1 | 10608 |
| 68 | W | R | F | D | A | T | L | E | I | I | 1 | 10609 |
| 95 | S | Y | H | S | S | H | E | P | L | P | 1 | 10610 |
| 113 | T | C | V | D | I | S | L | D | C | D | 1 | 10611 |
| 123 | L | N | C | E | G | R | Q | D | R | N | 1 | 10612 |
| 146 | Y | G | G | I | L | L | V | N | C | D | 1 | 10613 |
| 159 | P | S | C | D | V | Q | D | N | C | D | 1 | 10614 |
| 160 | S | C | D | V | Q | D | N | C | D | Q | 1 | 10615 |
| 165 | D | N | C | D | Q | H | V | H | C | L | 1 | 10616 |
| 171 | V | H | C | L | Q | D | L | E | D | M | 1 | 10617 |
| 203 | T | S | S | Y | D | A | K | R | A | Q | 1 | 10618 |
| 230 | L | G | Q | D | K | V | S | Y | E | V | 1 | 10619 |
| 236 | S | Y | E | V | P | R | L | H | G | D | 1 | 10620 |
| 249 | F | F | V | E | G | L | S | F | P | D | 1 | 10621 |
| 266 | S | F | H | V | T | L | L | D | D | S | 1 | 10622 |
| 277 | E | D | F | S | A | S | P | I | F | T | 1 | 10623 |
| 298 | M | T | P | S | T | L | P | P | L | E | 1 | 10624 |
| 308 | V | Y | V | C | R | V | R | N | N | T | 1 | 10625 |
| 342 | R | N | D | R | W | I | Q | D | E | 1 | 10626 |
| 361 | H | K | T | L | P | V | F | D | S | 1 | 10627 |
| 367 | V | F | D | S | P | R | N | G | E | L | 1 | 10628 |
| 386 | G | P | D | F | G | Y | V | T | R | E | 1 | 10629 |
| 407 | F | G | N | L | E | V | S | P | P | V | 1 | 10630 |
| 450 | L | H | A | Q | K | V | Q | P | P | V | 1 | 10631 |
| 486 | F | R | M | L | L | A | S | P | G | A | 1 | 10632 |
| 500 | F | Q | E | K | Q | K | C | G | H | G | 1 | 10633 |
| 502 | E | K | Q | K | C | G | H | G | R | A | 1 | 10634 |
| 529 | N | Q | V | L | S | N | K | D | L | I | 1 | 10635 |
| 540 | Y | N | K | F | V | Q | S | C | I | D | 1 | 10636 |
| 551 | N | R | E | V | L | K | R | E | L | G | 1 | 10637 |
| 593 | L | G | K | H | L | G | I | P | K | P | 1 | 10638 |
| 654 | P | F | S | F | K | W | W | N | M | V | 1 | 10639 |

184P1E2 v.2: HLA Peptide Scoring Results A3 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 8 | T | L | A | P | L | E | V | Y | V | C | 18 | 10640 |
| 2 | W | I | M | T | P | S | T | L | A | P | 12 | 10641 |
| 6 | P | S | T | L | A | P | L | E | V | Y | 11 | 10642 |
| 7 | S | T | L | A | P | L | E | V | Y | V | 9 | 10643 |
| 9 | L | A | P | L | E | V | Y | V | C | R | 9 | 10644 |
| 3 | I | M | T | P | S | T | L | A | P | L | 8 | 10645 |
| 10 | A | P | L | E | V | Y | V | C | R | V | 6 | 10646 |
| 1 | P | W | I | M | T | P | S | T | L | A | 4 | 10647 |
| 5 | T | P | S | T | L | A | P | L | E | V | 4 | 10648 |
| 4 | M | T | P | S | T | L | A | P | L | E | 3 | 10649 |

184P1E2 v.3: HLA Peptide Scoring Results A3 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 7 | F | V | P | V | P | D | G | K | G | F | 17 | 10650 |
| 9 | P | V | P | D | G | K | G | F | R | M | 14 | 10651 |
| 5 | L | S | F | V | P | V | P | D | G | K | 11 | 10652 |
| 4 | F | L | S | F | V | P | V | P | D | G | 10 | 10653 |
| 8 | V | P | V | P | D | G | K | G | F | R | 8 | 10654 |
| 3 | E | F | L | S | F | V | P | V | P | D | 7 | 10655 |
| 2 | D | E | F | L | S | F | V | P | V | P | 5 | 10656 |
| 6 | S | F | V | P | V | P | D | G | K | G | 5 | 10657 |

TABLE XXXIX-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 1 | V | D | E | F | L | S | F | V | P | V | 4 | 10658 |
| 10 | V | P | D | G | K | G | F | R | M | L | 3 | 10659' |

TABLE XL

| Pos | 1 | 2 | 3 | 4 | 5 | 6 | 7 | 8 | 9 | 0 | score | SEQ. ID NO. |
|---|---|---|---|---|---|---|---|---|---|---|---|---|
| | | | | 184P1E2 v.1: HLA Peptide Scoring Results A26 10-mers SYFPEITHI | | | | | | | |
| 176 | D | L | E | D | M | S | V | M | V | L | 28 | 10660 |
| 221 | D | V | C | E | A | Y | R | H | V | L | 26 | 10661 |
| 628 | C | T | F | I | D | D | F | T | P | Y | 26 | 10662 |
| 228 | H | V | L | G | Q | D | K | V | S | Y | 24 | 10663 |
| 325 | E | L | A | R | K | A | G | C | K | L | 24 | 10664 |
| 411 | E | V | S | P | P | V | V | A | N | G | 24 | 10665 |
| 465 | W | L | A | V | G | H | V | D | E | F | 24 | 10666 |
| 263 | G | L | I | S | F | H | V | T | L | L | 23 | 10667 |
| 531 | V | L | S | N | K | D | L | I | N | Y | 23 | 10668 |
| 582 | A | F | F | P | D | L | V | N | M | L | 23 | 10669 |
| 17 | A | V | C | V | A | G | V | E | T | L | 22 | 10670 |
| 347 | W | I | Q | D | E | M | E | L | G | Y | 22 | 10671 |
| 477 | F | V | P | A | P | D | G | K | G | F | 22 | 10672 |
| 625 | G | L | H | C | T | F | I | D | D | F | 22 | 10673 |
| 24 | G | V | D | I | Y | I | S | P | N | M | 21 | 10675 |
| 47 | D | T | R | R | W | R | F | D | A | T | 21 | 10676 |
| 101 | E | P | L | P | L | A | Y | A | V | L | 21 | 10677 |
| 233 | D | K | V | S | Y | E | V | P | R | L | 21 | 10678 |
| 255 | S | F | P | D | A | G | F | T | G | L | 21 | 10679 |
| 258 | D | A | G | F | T | G | L | I | S | F | 21 | 10680 |
| 287 | D | T | V | V | F | R | V | A | P | W | 21 | 10681 |
| 307 | E | V | Y | V | C | R | V | R | N | N | 21 | 10682 |
| 395 | E | P | R | D | R | S | V | S | G | L | 21 | 10683 |
| 398 | D | R | S | V | S | G | L | D | S | F | 21 | 10684 |
| 460 | E | L | F | V | D | W | L | A | V | G | 21 | 10685 |
| 553 | E | V | L | K | R | E | L | G | L | A | 21 | 10686 |
| 563 | E | C | D | I | I | D | I | P | Q | L | 21 | 10687 |
| 574 | K | T | E | R | K | K | A | T | A | F | 21 | 10688 |
| 630 | F | I | D | D | F | T | P | Y | H | M | 21 | 10689 |
| 86 | D | L | N | D | S | H | V | Q | I | S | 20 | 10690 |
| 102 | P | L | P | L | A | Y | A | V | L | Y | 20 | 10691 |
| 241 | R | L | H | G | D | E | E | R | F | F | 20 | 10692 |
| 289 | V | V | F | R | V | A | P | W | I | M | 20 | 10693 |
| 375 | E | L | Q | D | F | P | Y | K | R | I | 20 | 10694 |
| 28 | D | I | Y | G | S | V | P | E | G | T | 19 | 10695 |
| 41 | E | V | Y | G | T | P | G | V | D | I | 19 | 10696 |
| 61 | E | R | A | D | T | R | R | W | R | F | 19 | 10697 |
| 71 | D | A | T | L | E | I | I | V | V | M | 19 | 10698 |
| 75 | E | I | I | V | V | M | N | S | P | S | 19 | 10699 |
| 114 | C | V | D | I | S | L | D | C | D | L | 19 | 10700 |
| 162 | D | V | Q | D | N | C | D | Q | H | V | 19 | 10701 |
| 165 | D | N | C | D | Q | H | V | H | C | L | 19 | 10702 |
| 168 | D | Q | H | V | H | C | L | Q | D | L | 19 | 10703 |
| 192 | A | L | F | D | D | H | K | L | V | L | 19 | 10704 |
| 245 | D | E | E | R | F | F | V | E | G | L | 19 | 10705 |
| 247 | E | R | F | F | V | E | G | L | S | F | 19 | 10706 |
| 252 | E | G | L | S | F | P | D | A | G | F | 19 | 10707 |
| 270 | T | L | L | D | D | S | N | E | D | F | 19 | 10708 |
| 416 | V | A | N | G | K | E | Y | P | L | L | 19 | 10709 |
| 441 | R | V | T | Q | V | V | R | D | F | L | 19 | 10710 |
| 488 | M | L | L | A | S | P | G | A | C | F | 19 | 10711 |
| 565 | D | I | I | D | I | P | Q | L | F | K | 19 | 10712 |
| 568 | D | I | P | Q | L | F | K | T | E | R | 19 | 10713 |
| 586 | D | L | V | N | M | L | V | L | G | K | 19 | 10714 |
| 612 | C | L | E | E | K | V | R | S | L | L | 19 | 10715 |
| 633 | D | F | T | P | Y | H | M | L | H | G | 19 | 10716 |
| 2 | S | L | Q | R | I | V | R | V | S | L | 18 | 10717 |
| 49 | D | I | Y | I | S | P | N | M | E | V | 18 | 10718 |
| 72 | A | T | L | E | I | I | V | V | M | N | 18 | 10719 |
| 78 | V | V | M | N | S | P | S | N | D | L | 18 | 10720 |
| 184 | V | L | R | T | Q | G | P | A | A | L | 18 | 10721 |
| 238 | E | V | P | R | L | H | G | D | E | E | 18 | 10722 |

TABLE XL-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 378 | D | F | P | Y | K | R | I | L | G | P | 18 | 10723 |
| 428 | I | L | I | G | G | N | L | P | G | S | 17 | 10724 |
| 615 | E | K | V | R | S | L | L | E | P | L | 17 | 10725 |
| 44 | G | T | P | G | V | D | I | Y | I | S | 17 | 10726 |
| 116 | D | I | S | L | D | C | D | L | N | C | 17 | 10727 |
| 250 | F | V | E | G | L | S | F | P | D | A | 17 | 10728 |
| 283 | P | I | F | T | D | T | V | V | F | R | 17 | 10729 |
| 292 | R | V | A | P | W | I | M | T | P | S | 17 | 10730 |
| 362 | K | T | L | P | V | V | F | D | S | P | 17 | 10731 |
| 367 | V | F | D | S | P | R | N | G | E | L | 17 | 10732 |
| 491 | A | S | P | G | A | C | F | K | L | F | 17 | 10733 |
| 643 | E | V | H | C | G | T | N | V | C | R | 17 | 10734 |
| 14 | P | T | S | A | V | C | V | A | G | V | 16 | 10735 |
| 21 | A | G | V | E | T | L | V | D | I | Y | 16 | 10736 |
| 278 | D | F | S | A | S | P | I | F | T | D | 16 | 10737 |
| 317 | T | C | F | V | D | A | V | A | E | L | 16 | 10738 |
| 345 | D | R | W | I | Q | D | E | M | E | L | 16 | 10739 |
| 353 | E | L | G | Y | V | O | A | P | H | K | 16 | 10740 |
| 383 | R | I | L | G | P | D | F | G | Y | V | 16 | 10741 |
| 462 | F | V | D | W | L | A | V | G | H | V | 16 | 10742 |
| 480 | A | P | D | G | K | G | F | R | M | L | 16 | 10743 |
| 517 | V | V | D | D | E | Q | V | K | T | I | 16 | 10744 |
| 522 | Q | V | K | T | I | S | I | N | Q | V | 16 | 10745 |
| 534 | N | K | D | L | I | N | Y | N | K | F | 16 | 10746 |
| 536 | D | L | I | N | Y | N | K | F | V | Q | 16 | 10747 |
| 537 | L | I | N | Y | N | K | F | V | Q | S | 16 | 10748 |
| 566 | I | I | D | I | P | Q | L | F | K | T | 16 | 10749 |
| 581 | T | A | F | F | P | D | L | V | N | M | 16 | 10750 |
| 591 | L | V | L | G | K | H | L | G | I | P | 16 | 10751 |
| 634 | F | T | P | Y | H | M | L | H | G | E | 16 | 10752 |
| 5 | R | I | V | R | V | S | L | E | H | P | 15 | 10753 |
| 36 | G | T | E | M | F | E | V | Y | G | T | 15 | 10754 |
| 122 | D | L | N | C | E | G | R | Q | D | R | 15 | 10755 |
| 285 | F | T | D | T | V | V | F | R | V | A | 15 | 10756 |
| 297 | I | M | T | P | S | T | L | P | P | L | 15 | 10757 |
| 302 | T | L | P | P | L | E | V | Y | V | C | 15 | 10758 |
| 370 | S | P | R | N | G | E | L | Q | D | F | 15 | 10759 |
| 444 | Q | V | V | R | D | F | L | H | A | Q | 15 | 10760 |
| 453 | Q | K | V | Q | P | P | V | E | L | F | 15 | 10761 |
| 468 | V | G | H | V | D | E | F | L | S | F | 15 | 10762 |
| 512 | L | L | F | Q | G | V | V | D | D | E | 15 | 10763 |
| 525 | T | I | S | I | N | Q | V | L | S | N | 15 | 10764 |
| 560 | G | L | A | E | C | D | I | I | D | I | 15 | 10765 |
| 587 | L | V | N | M | L | V | L | G | K | H | 15 | 10766 |
| 611 | C | C | L | E | E | K | V | R | S | L | 15 | 10767 |
| 649 | N | V | C | R | K | P | F | S | F | S | 15 | 10768 |
| 32 | S | V | P | E | G | T | E | M | F | E | 14 | 10769 |
| 34 | P | E | G | T | E | M | F | E | V | Y | 14 | 10770 |
| 42 | V | Y | G | T | P | G | V | D | I | Y | 14 | 10771 |
| 73 | T | L | E | I | I | V | V | M | N | S | 14 | 10772 |
| 174 | Q | D | L | E | D | M | S | V | M | V | 14 | 10773 |
| 212 | Q | V | F | H | I | C | G | P | E | D | 14 | 10774 |
| 217 | C | G | P | E | D | V | C | E | A | Y | 14 | 10775 |
| 229 | V | L | G | Q | D | K | V | S | Y | E | 14 | 10776 |
| 261 | F | T | G | L | I | S | F | H | V | T | 14 | 10777 |
| 300 | P | S | T | L | P | P | L | E | V | Y | 14 | 10778 |
| 322 | A | V | A | E | L | A | R | K | A | G | 14 | 10779 |
| 350 | D | E | M | E | L | G | Y | V | Q | A | 14 | 10780 |
| 366 | V | V | F | D | S | P | R | N | G | E | 14 | 10781 |
| 440 | R | R | V | T | Q | V | V | R | D | F | 14 | 10782 |
| 448 | D | F | L | H | A | Q | K | V | Q | P | 14 | 10783 |
| 457 | P | P | V | E | L | F | V | D | W | L | 14 | 10784 |
| 472 | D | E | F | L | S | F | V | P | A | P | 14 | 10785 |
| 473 | E | F | L | S | F | V | P | A | P | D | 14 | 10786 |
| 524 | K | T | I | S | I | N | Q | V | L | S | 14 | 10787 |
| 558 | E | L | G | L | A | E | C | D | I | I | 14 | 10788 |
| 578 | K | K | A | T | A | F | F | P | D | L | 14 | 10789 |
| 620 | L | L | E | P | L | G | L | H | C | T | 14 | 10790 |
| 631 | I | D | D | F | T | P | Y | H | M | L | 14 | 10791 |
| 19 | C | V | A | G | V | E | T | L | V | D | 13 | 10792 |
| 31 | P | S | V | P | E | G | T | E | M | F | 13 | 10793 |
| 51 | Y | I | S | P | N | M | E | R | G | R | 13 | 10794 |
| 87 | L | N | D | S | H | V | Q | I | S | Y | 13 | 10795 |
| 98 | S | S | H | E | P | L | P | L | A | Y | 13 | 10796 |
| 104 | P | L | A | Y | A | V | L | Y | L | T | 13 | 10797 |
| 111 | Y | L | T | C | V | D | I | S | L | D | 13 | 10798 |

TABLE XL-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 124 | N | C | E | G | R | Q | D | R | N | F | 13 | 10799 |
| 133 | F | V | D | K | R | Q | W | V | W | G | 13 | 10800 |
| 139 | W | V | W | G | P | S | G | Y | G | G | 13 | 10801 |
| 157 | D | D | P | S | C | D | V | Q | D | N | 13 | 10802 |
| 193 | L | F | D | D | H | K | L | V | L | H | 13 | 10803 |
| 200 | V | L | H | T | S | S | Y | D | A | K | 13 | 10804 |
| 215 | H | I | C | G | P | E | D | V | C | E | 13 | 10805 |
| 248 | R | F | F | V | E | G | L | S | F | P | 13 | 10806 |
| 282 | S | P | I | F | T | D | T | V | V | F | 13 | 10807 |
| 298 | M | T | P | S | T | L | P | P | L | E | 13 | 10808 |
| 301 | S | T | L | P | P | L | E | V | Y | V | 13 | 10809 |
| 334 | L | T | I | C | P | Q | A | E | N | R | 13 | 10810 |
| 335 | T | I | C | P | Q | A | E | N | R | N | 13 | 10811 |
| 382 | K | R | I | L | G | P | D | F | G | Y | 13 | 10812 |
| 392 | V | T | R | E | P | R | D | R | S | V | 13 | 10813 |
| 400 | S | V | S | G | L | D | S | F | G | N | 13 | 10814 |
| 401 | V | S | G | L | D | S | F | G | N | L | 13 | 10815 |
| 424 | P | L | G | R | I | L | I | G | G | N | 13 | 10816 |
| 429 | L | I | G | G | N | L | P | G | S | S | 13 | 10817 |
| 445 | V | V | R | D | F | L | H | A | Q | K | 13 | 10818 |
| 449 | F | L | H | A | Q | K | V | Q | P | P | 13 | 10819 |
| 470 | H | V | D | E | F | L | S | F | V | P | 13 | 10820 |
| 482 | D | G | K | G | F | R | M | L | L | A | 13 | 10821 |
| 511 | A | L | L | F | Q | G | V | V | D | D | 13 | 10822 |
| 516 | G | V | V | D | D | E | Q | V | K | T | 13 | 10823 |
| 564 | C | D | I | I | D | I | P | Q | L | F | 13 | 10824 |
| 584 | F | P | D | L | V | N | M | L | V | L | 13 | 10825 |
| 598 | G | I | P | K | P | F | G | P | I | I | 13 | 10826 |
| 606 | I | I | N | G | C | C | C | L | E | E | 13 | 10827 |
| 26 | L | V | D | I | Y | G | S | V | P | E | 12 | 10828 |
| 76 | I | V | V | M | N | S | P | S | N | | 12 | 10829 |
| 77 | I | V | V | M | N | S | P | S | N | D | 12 | 10830 |
| 91 | H | V | Q | I | S | Y | H | S | S | H | 12 | 10831 |
| 103 | L | P | L | A | Y | A | V | L | Y | L | 12 | 10832 |
| 109 | V | L | Y | L | T | C | V | D | I | S | 12 | 10833 |
| 137 | R | Q | W | V | W | G | P | S | G | Y | 12 | 10834 |
| 171 | V | H | C | L | Q | D | L | S | D | M | 12 | 10835 |
| 178 | E | D | M | S | V | M | V | L | R | T | 12 | 10836 |
| 181 | S | V | M | V | L | R | T | Q | G | P | 12 | 10837 |
| 183 | M | V | L | R | T | Q | G | P | A | A | 12 | 10838 |
| 185 | L | R | T | Q | G | P | A | A | L | F | 12 | 10839 |
| 186 | R | T | Q | G | P | A | A | L | F | D | 12 | 10840 |
| 197 | H | K | L | V | L | H | T | S | S | Y | 12 | 10841 |
| 202 | H | T | S | S | Y | D | A | K | R | A | 12 | 10842 |
| 205 | S | Y | D | A | K | R | A | Q | V | F | 12 | 10843 |
| 207 | D | A | K | R | A | Q | V | F | H | I | 12 | 10844 |
| 268 | H | V | T | L | L | D | D | S | N | E | 12 | 10845 |
| 273 | D | D | S | N | E | D | F | S | A | S | 12 | 10846 |
| 276 | N | E | D | F | S | A | S | P | I | F | 12 | 10847 |
| 284 | I | F | T | D | T | V | V | F | R | V | 12 | 10848 |
| 316 | N | T | C | F | V | D | A | V | A | E | 12 | 10849 |
| 319 | F | V | D | A | V | A | E | L | A | R | 12 | 10850 |
| 351 | E | H | S | L | G | Y | V | Q | A | P | 12 | 10851 |
| 359 | A | P | H | K | T | L | P | V | V | F | 12 | 10852 |
| 372 | R | N | G | E | L | Q | D | F | P | Y | 12 | 10853 |
| 380 | P | Y | K | R | I | L | G | P | D | F | 12 | 10854 |
| 388 | D | F | G | Y | V | T | R | E | P | R | 12 | 10855 |
| 405 | D | S | F | G | N | L | E | V | S | P | 12 | 10856 |
| 433 | N | L | P | G | S | S | G | R | R | V | 12 | 10857 |
| 454 | K | V | Q | P | P | V | E | L | F | V | 12 | 10858 |
| 527 | S | I | N | Q | V | L | S | N | K | D | 12 | 10859 |
| 543 | F | V | Q | S | C | I | D | W | N | R | 12 | 10860 |
| 547 | C | I | D | W | N | R | S | V | L | K | 12 | 10861 |
| 571 | Q | L | F | K | T | E | R | K | K | A | 12 | 10862 |
| 575 | T | E | R | K | K | A | T | A | F | F | 12 | 10863 |
| 605 | P | I | I | N | G | C | C | C | L | B | 12 | 10864 |
| 614 | E | E | K | V | R | S | L | L | E | P | 12 | 10865 |
| 616 | K | V | R | S | L | L | E | P | L | G | 12 | 10866 |
| 653 | K | P | F | S | F | K | W | W | N | M | 12 | 10867 |
| 8 | R | V | S | L | E | H | P | T | S | A | 11 | 10868 |
| 12 | E | H | P | T | S | A | V | C | V | A | 11 | 10869 |
| 93 | Q | I | S | Y | H | S | S | H | E | P | 11 | 10870 |
| 108 | A | V | L | Y | L | T | C | V | D | I | 11 | 10871 |
| 148 | G | I | L | L | V | N | C | D | R | D | 11 | 10872 |
| 170 | H | V | H | C | L | Q | D | L | S | D | 11 | 10873 |
| 173 | C | L | Q | D | L | S | D | M | S | V | 11 | 10874 |
| 195 | D | D | H | K | L | V | L | H | T | S | 11 | 10875 |
| 220 | E | D | V | C | S | A | Y | R | H | V | 11 | 10876 |
| 224 | E | A | Y | R | H | V | L | G | Q | D | 11 | 10877 |
| 240 | P | R | L | H | G | D | E | E | R | F | 11 | 10878 |
| 269 | V | T | L | L | D | D | S | N | E | D | 11 | 10879 |
| 288 | T | V | V | F | R | V | A | P | W | I | 11 | 10880 |
| 365 | P | V | V | F | D | S | P | R | N | G | 11 | 10881 |
| 391 | Y | V | T | R | E | P | R | D | R | S | 11 | 10882 |
| 403 | G | L | D | S | F | G | N | L | E | V | 11 | 10883 |
| 406 | S | F | G | N | L | E | V | S | P | P | 11 | 10884 |
| 414 | P | P | V | V | A | N | G | K | E | Y | 11 | 10885 |
| 422 | E | Y | P | L | G | R | I | L | I | G | 11 | 10886 |
| 452 | A | Q | K | V | Q | P | P | V | E | L | 11 | 10887 |
| 479 | P | A | P | D | G | K | G | F | R | M | 11 | 10888 |
| 490 | L | A | S | P | G | A | C | F | K | L | 11 | 10889 |
| 498 | K | L | F | Q | E | K | Q | K | C | G | 11 | 10890 |
| 504 | Q | K | C | G | H | G | R | A | L | L | 11 | 10891 |
| 520 | D | E | Q | V | K | T | I | S | I | N | 11 | 10892 |
| 530 | Q | V | L | S | N | K | D | L | I | N | 11 | 10893 |
| 542 | K | F | V | Q | S | C | I | D | W | N | 11 | 10894 |
| 546 | S | C | I | D | W | N | R | E | V | L | 11 | 10895 |
| 549 | D | W | N | R | E | V | L | K | R | E | 11 | 10896 |
| 550 | W | N | R | E | V | L | K | R | E | L | 11 | 10897 |
| 580 | A | T | A | F | F | P | D | L | V | N | 11 | 10898 |
| 619 | S | L | L | E | P | L | G | L | H | C | 11 | 10899 |
| 621 | L | E | P | L | G | L | H | C | T | F | 11 | 10900 |
| 639 | M | L | H | G | E | V | H | C | G | T | 11 | 10901 |
| 647 | G | T | N | V | C | R | K | P | F | S | 11 | 10902 |
| 648 | T | N | V | C | R | K | P | F | S | F | 11 | 10903 |
| 6 | I | V | R | V | S | L | E | H | P | T | 10 | 10904 |
| 22 | G | V | E | T | L | V | D | I | Y | G | 10 | 10905 |
| 25 | T | L | V | D | I | Y | G | S | V | P | 10 | 10906 |
| 38 | E | M | F | E | V | Y | G | T | P | G | 10 | 10907 |
| 112 | L | T | C | V | D | I | S | L | D | C | 10 | 10908 |
| 118 | S | L | D | C | D | L | N | C | E | G | 10 | 10909 |
| 141 | W | G | P | S | G | Y | G | G | I | L | 10 | 10910 |
| 142 | G | P | S | G | Y | G | G | I | L | L | 10 | 10911 |
| 151 | L | V | N | C | D | R | D | D | P | S | 10 | 10912 |
| 179 | D | M | S | V | M | V | L | R | T | Q | 10 | 10913 |
| 190 | P | A | A | L | F | D | D | H | K | L | 10 | 10914 |
| 199 | L | V | L | H | T | S | S | Y | D | A | 10 | 10915 |
| 234 | K | V | S | Y | E | V | P | R | L | H | 10 | 10916 |
| 264 | L | I | S | F | H | V | T | L | L | D | 10 | 10917 |
| 266 | S | F | H | V | T | L | L | D | D | S | 10 | 10918 |
| 271 | L | L | D | D | S | N | E | D | F | S | 10 | 10919 |
| 274 | D | S | N | E | D | F | S | A | S | P | 10 | 10920 |
| 296 | W | I | M | T | P | S | T | L | P | P | 10 | 10921 |
| 309 | Y | V | C | R | V | R | N | N | T | C | 10 | 10922 |
| 310 | V | C | R | V | R | N | N | T | C | F | 10 | 10923 |
| 312 | R | V | R | N | N | T | C | F | V | D | 10 | 10924 |
| 333 | K | L | T | I | C | P | Q | A | E | N | 10 | 10925 |
| 343 | R | N | D | R | W | I | Q | D | E | M | 10 | 10926 |
| 356 | Y | V | Q | A | P | H | K | T | L | P | 10 | 10927 |
| 363 | T | L | P | V | V | F | D | S | P | R | 10 | 10928 |
| 384 | I | L | G | P | D | F | G | Y | V | T | 10 | 10929 |
| 415 | P | V | V | A | N | G | K | E | Y | P | 10 | 10930 |
| 427 | R | I | L | I | G | G | N | L | P | G | 10 | 10931 |
| 442 | V | T | Q | V | V | R | D | F | L | H | 10 | 10932 |
| 458 | P | V | E | L | F | V | D | W | L | A | 10 | 10933 |
| 466 | L | A | V | G | H | V | D | E | F | L | 10 | 10934 |
| 467 | A | V | G | H | V | D | E | F | L | S | 10 | 10935 |
| 481 | P | D | G | K | G | F | R | M | L | L | 10 | 10936 |
| 489 | L | L | A | S | P | G | A | C | F | K | 10 | 10937 |
| 503 | K | Q | K | C | G | H | G | R | A | L | 10 | 10938 |
| 505 | K | C | G | H | G | R | A | L | L | F | 10 | 10939 |
| 554 | V | L | K | R | E | L | G | L | A | E | 10 | 10940 |
| 594 | G | K | H | L | G | I | P | K | P | F | 10 | 10941 |
| 604 | G | P | I | I | N | G | C | C | C | L | 10 | 10942 |
| 629 | T | F | I | D | D | F | T | P | Y | H | 10 | 10943 |
| 646 | C | G | T | N | V | C | R | K | P | F | 10 | 10944 |
| 10 | S | L | E | H | P | T | S | A | V | C | 9 | 10945 |
| 30 | Y | G | S | V | P | E | G | T | E | M | 9 | 10946 |
| 35 | E | G | T | E | M | F | E | V | Y | G | 9 | 10947 |
| 65 | T | R | R | W | R | F | D | A | T | L | 9 | 10948 |
| 96 | Y | H | S | S | H | E | P | L | P | L | 9 | 10949 |
| 110 | L | Y | L | T | C | V | D | I | S | L | 9 | 10950 |

TABLE XL-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 198 | K | L | V | L | H | T | S | S | Y | D | 9 | 10951 |
| 260 | G | F | T | G | L | I | S | F | H | V | 9 | 10952 |
| 262 | T | G | L | I | S | F | H | V | T | L | 9 | 10953 |
| 277 | E | D | F | S | A | S | P | I | F | T | 9 | 10954 |
| 294 | A | P | W | I | M | T | P | S | T | L | 9 | 10955 |
| 355 | G | Y | V | Q | A | P | H | K | T | L | 9 | 10956 |
| 376 | L | Q | D | F | P | Y | K | R | I | L | 9 | 10957 |
| 409 | N | L | E | V | S | P | P | V | V | A | 9 | 10958 |
| 425 | L | G | R | I | L | I | G | G | N | L | 9 | 10959 |
| 461 | L | F | V | D | W | L | A | V | G | H | 9 | 10960 |
| 474 | F | L | S | F | V | P | A | P | D | G | 9 | 10961 |
| 476 | S | F | V | P | A | P | D | G | K | G | 9 | 10962 |
| 499 | L | F | Q | E | K | Q | K | C | G | H | 9 | 10963 |
| 513 | L | F | Q | G | V | V | D | D | E | Q | 9 | 10964 |
| 523 | V | K | T | I | S | I | N | Q | V | L | 9 | 10965 |
| 552 | R | E | V | L | K | R | E | L | G | L | 9 | 10966 |
| 583 | F | F | P | D | L | V | N | M | L | V | 9 | 10967 |
| 588 | V | N | M | L | V | L | G | K | H | L | 9 | 10968 |
| 590 | M | L | V | L | G | K | H | L | G | I | 9 | 10969 |
| 592 | V | L | G | K | H | L | G | I | P | K | 9 | 10970 |
| 596 | H | L | G | I | P | K | P | F | G | P | 9 | 10971 |
| 601 | K | P | F | G | P | I | I | N | G | C | 9 | 10972 |
| 617 | V | R | S | L | L | E | P | L | G | L | 9 | 10973 |
| 632 | D | D | F | T | P | Y | H | M | L | H | 9 | 10974 |
| 27 | V | D | I | Y | G | S | V | P | E | G | 8 | 10975 |
| 39 | M | F | E | V | Y | G | T | P | G | V | 8 | 10976 |
| 50 | I | Y | I | S | P | N | H | H | P | G | 8 | 10977 |
| 94 | I | S | Y | H | S | S | H | E | P | L | 8 | 10978 |
| 120 | D | C | D | L | N | C | E | G | R | Q | 8 | 10979 |
| 145 | G | Y | G | G | I | L | L | V | N | C | 8 | 10980 |
| 149 | I | L | L | V | N | C | D | R | D | Q | 8 | 10981 |
| 150 | L | L | V | N | C | D | R | D | D | P | 8 | 10982 |
| 155 | D | P | D | D | P | S | C | D | V | Q | 8 | 10983 |
| 196 | D | H | K | L | V | L | H | T | S | S | 8 | 10984 |
| 244 | G | D | E | E | P | F | F | V | E | G | 8 | 10985 |
| 249 | F | F | V | E | G | L | S | F | P | D | 8 | 10986 |
| 253 | G | L | S | F | P | D | A | G | F | T | 8 | 10987 |
| 305 | P | L | E | V | Y | V | C | P | V | P | 8 | 10988 |
| 369 | D | S | P | R | N | G | E | L | Q | D | 8 | 10989 |
| 419 | N | G | K | E | Y | P | L | G | R | I | 8 | 10990 |
| 420 | G | K | E | Y | P | L | G | R | I | L | 8 | 10991 |
| 484 | K | G | F | P | M | L | L | A | S | P | 8 | 10992 |
| 496 | C | F | K | L | F | Q | E | K | Q | K | 8 | 10993 |
| 502 | E | K | Q | K | C | G | H | G | R | A | 8 | 10994 |
| 519 | D | D | E | Q | V | K | T | I | S | I | 8 | 10995 |
| 521 | E | Q | V | K | T | I | S | I | N | Q | 8 | 10996 |
| 526 | I | S | I | N | Q | V | L | S | N | K | 8 | 10997 |
| 528 | I | N | Q | V | L | S | N | K | D | L | 8 | 10998 |
| 555 | L | K | R | E | L | G | L | A | E | C | 8 | 10999 |
| 567 | I | D | I | P | Q | L | F | K | T | E | 8 | 11000 |
| 572 | L | F | K | T | E | P | K | K | A | T | 8 | 11001 |
| 576 | E | R | K | K | A | T | A | F | F | P | 8 | 11002 |
| 597 | L | G | I | P | K | P | F | G | P | I | 8 | 11003 |
| 602 | P | F | G | P | I | I | N | G | C | C | 8 | 11004 |
| 622 | E | P | L | G | L | H | C | T | F | I | 8 | 11005 |
| 623 | P | L | G | L | H | C | T | F | I | D | 8 | 11006 |
| 33 | V | P | E | G | T | E | N | F | H | V | 7 | 11007 |
| 68 | N | P | F | D | A | V | L | H | I | I | 7 | 11008 |
| 69 | R | F | D | A | T | L | E | I | I | V | 7 | 11009 |
| 74 | L | E | I | I | V | V | N | N | S | P | 7 | 11010 |
| 89 | D | S | H | V | Q | I | S | Y | H | S | 7 | 11011 |
| 99 | S | H | E | P | L | P | L | A | Y | A | 7 | 11012 |
| 126 | E | G | R | Q | D | P | N | F | V | D | 7 | 11013 |
| 130 | D | P | N | F | V | D | K | R | Q | W | 7 | 11014 |
| 132 | N | F | V | D | K | P | Q | N | V | W | 7 | 11015 |
| 135 | D | K | P | Q | N | V | W | G | P | S | 7 | 11016 |
| 140 | V | N | G | P | S | G | Y | G | G | I | 7 | 11017 |
| 158 | D | P | S | C | D | V | Q | D | N | C | 7 | 11018 |
| 216 | I | C | G | P | E | D | V | C | E | A | 7 | 11019 |
| 243 | H | G | D | E | E | R | F | F | V | E | 7 | 11020 |
| 259 | A | G | F | T | G | L | I | S | F | H | 7 | 11021 |
| 290 | V | F | R | V | A | P | V | I | M | T | 7 | 11022 |
| 304 | P | P | L | E | V | Y | V | C | P | V | 7 | 11023 |
| 318 | C | F | V | D | A | V | A | E | L | A | 7 | 11024 |
| 320 | V | D | A | V | A | E | L | A | R | K | 7 | 11025 |
| 321 | D | A | V | A | E | L | A | P | K | A | 7 | 11026 |
| 328 | R | K | A | G | C | K | L | T | I | C | 7 | 11027 |
| 341 | E | N | R | N | D | P | N | I | Q | D | 7 | 11028 |
| 346 | R | W | I | Q | D | E | M | E | L | G | 7 | 11029 |
| 348 | I | Q | D | E | M | E | L | G | Y | V | 7 | 11030 |
| 385 | L | G | P | D | F | G | Y | V | T | R | 7 | 11031 |
| 410 | L | E | V | S | P | P | V | V | A | N | 7 | 11032 |
| 417 | V | A | N | G | K | E | Y | P | L | G | 7 | 11033 |
| 423 | Y | P | L | G | P | I | L | I | G | G | 7 | 11034 |
| 436 | G | S | S | G | P | R | V | T | Q | V | 7 | 11035 |
| 455 | V | Q | P | P | V | E | L | F | V | D | 7 | 11036 |
| 464 | D | W | L | A | V | G | H | V | D | E | 7 | 11037 |
| 485 | G | F | R | M | L | L | A | S | P | G | 7 | 11038 |
| 593 | L | G | K | H | L | G | I | P | K | P | 7 | 11039 |
| 644 | V | H | C | G | T | N | V | C | R | K | 7 | 11040 |
| 651 | C | R | K | P | F | S | F | K | N | W | 7 | 11041 |
| 654 | P | F | S | F | K | W | N | N | N | V | 7 | 11042 |
| 46 | P | G | V | D | I | Y | I | S | P | N | 6 | 11043 |
| 57 | E | R | G | P | E | R | A | D | T | R | 6 | 11044 |
| 81 | N | S | P | S | N | D | L | N | D | S | 6 | 11045 |
| 90 | S | H | V | Q | I | S | Y | H | S | S | 6 | 11046 |
| 127 | G | R | Q | D | R | N | F | V | D | K | 6 | 11047 |
| 128 | R | Q | D | R | N | F | V | D | K | P | 6 | 11048 |
| 134 | V | D | K | P | Q | W | V | W | G | P | 6 | 11049 |
| 144 | S | G | Y | G | G | I | L | L | V | N | 6 | 11050 |
| 177 | L | E | D | M | S | V | N | V | L | P | 6 | 11051 |
| 187 | T | Q | D | P | A | A | L | F | D | D | 6 | 11052 |
| 194 | F | D | D | H | K | L | V | L | H | T | 6 | 11053 |
| 213 | V | F | H | I | C | G | P | E | D | V | 6 | 11054 |
| 223 | C | E | A | Y | R | H | V | L | G | Q | 6 | 11055 |
| 231 | G | Q | D | K | V | S | Y | E | V | P | 6 | 11056 |
| 246 | E | E | R | F | F | V | E | G | L | S | 6 | 11057 |
| 265 | I | S | F | H | V | T | L | L | D | D | 6 | 11058 |
| 279 | F | S | A | S | P | I | F | T | D | T | 6 | 11059 |
| 303 | L | P | P | L | E | V | Y | Y | V | C | 6 | 11060 |
| 342 | N | R | N | D | R | N | I | Q | V | H | 6 | 11061 |
| 358 | Q | A | P | H | K | V | L | P | V | V | 6 | 11062 |
| 360 | P | H | K | T | L | P | V | V | F | V | 6 | 11063 |
| 386 | G | P | D | F | G | Y | V | T | P | H | 6 | 11064 |
| 439 | G | R | P | V | T | Q | V | V | R | D | 6 | 11065 |
| 456 | Q | P | P | V | E | L | F | V | D | W | 6 | 11066 |
| 469 | G | H | V | D | E | F | L | S | F | V | 6 | 11067 |
| 493 | P | G | A | C | F | K | L | F | Q | E | 6 | 11068 |
| 494 | G | A | C | F | K | L | F | Q | P | K | 6 | 11069 |
| 506 | C | G | H | G | R | A | L | L | F | Q | 6 | 11070 |
| 508 | H | G | R | A | L | L | F | Q | G | V | 6 | 11071 |
| 538 | I | N | Y | N | K | F | V | Q | S | C | 6 | 11072 |
| 600 | P | K | P | F | G | P | I | I | N | G | 6 | 11073 |
| 1 | M | S | L | Q | R | I | V | R | V | S | 5 | 11074 |
| 3 | L | Q | P | I | V | R | V | S | L | P | 5 | 11075 |
| 20 | V | A | G | V | P | T | L | V | D | I | 5 | 11076 |
| 23 | V | E | V | L | V | D | I | Y | G | S | 5 | 11077 |
| 45 | T | P | G | V | D | I | Y | I | S | P | 5 | 11078 |
| 70 | F | D | A | T | L | P | I | I | V | V | 5 | 11079 |
| 88 | N | D | S | H | V | Q | I | S | Y | H | 5 | 11080 |
| 92 | V | Q | I | S | Y | H | S | S | H | E | 5 | 11081 |
| 97 | H | S | S | H | E | P | L | P | L | A | 5 | 11082 |
| 106 | A | Y | A | V | L | Y | L | T | C | V | 5 | 11083 |
| 113 | T | C | V | D | I | S | L | D | C | D | 5 | 11084 |
| 117 | I | S | L | D | C | D | L | N | C | E | 5 | 11085 |
| 156 | R | D | D | P | S | C | D | V | Q | D | 5 | 11086 |
| 188 | Q | G | P | A | A | L | F | D | D | H | 5 | 11087 |
| 210 | R | A | Q | V | F | H | I | C | G | P | 5 | 11088 |
| 236 | S | Y | E | V | P | R | L | H | G | D | 5 | 11089 |
| 291 | F | P | V | A | P | W | I | M | T | P | 5 | 11090 |
| 313 | V | R | N | N | T | C | F | V | D | A | 5 | 11091 |
| 314 | R | N | N | T | C | F | V | D | A | V | 5 | 11092 |
| 330 | A | G | C | K | L | T | I | C | P | Q | 5 | 11093 |
| 373 | N | G | E | L | Q | D | F | P | Y | K | 5 | 11094 |
| 379 | F | P | Y | K | R | I | L | G | P | D | 5 | 11095 |
| 387 | P | D | F | G | Y | V | T | R | E | P | 5 | 11096 |
| 443 | T | Q | V | V | R | D | F | L | H | A | 5 | 11097 |
| 471 | V | D | E | F | L | S | F | V | P | A | 5 | 11098 |
| 483 | K | G | F | P | M | L | L | A | S | 5 | 11099 |
| 507 | G | H | G | R | A | L | L | F | Q | G | 5 | 11100 |
| 532 | L | S | N | K | D | L | I | N | Y | N | 5 | 11101 |
| 548 | I | D | W | N | R | P | V | L | K | R | 5 | 11102 |

TABLE XL-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 577 | R | K | K | A | T | A | F | F | P | D | 5 | 11103 |
| 585 | P | D | L | V | N | M | L | V | L | G | 5 | 11104 |
| 607 | I | N | G | C | C | C | L | E | E | K | 5 | 11105 |
| 9 | V | S | L | E | H | P | T | S | A | V | 4 | 11106 |
| 37 | T | E | M | F | E | V | Y | G | T | P | 4 | 11107 |
| 105 | L | A | Y | A | V | L | Y | L | T | C | 4 | 11108 |
| 143 | P | S | G | Y | G | I | L | L | L | V | 4 | 11109 |
| 146 | Y | G | G | I | L | L | V | N | C | D | 4 | 11110 |
| 175 | Q | D | L | P | D | M | S | V | M | V | 4 | 11111 |
| 208 | A | K | P | A | Q | V | F | H | I | C | 4 | 11112 |
| 254 | L | S | F | P | D | A | G | F | T | G | 4 | 11113 |
| 338 | P | Q | A | E | N | R | N | D | R | W | 4 | 11114 |
| 361 | H | K | T | L | P | V | V | F | D | S | 4 | 11115 |
| 377 | Q | D | F | P | Y | K | R | I | L | G | 4 | 11116 |
| 404 | L | D | S | F | G | N | L | E | V | S | 4 | 11117 |
| 412 | V | S | P | P | V | V | A | N | G | K | 4 | 11118 |
| 495 | A | C | F | K | L | F | Q | E | K | Q | 4 | 11119 |
| 561 | L | A | P | C | D | I | I | D | I | P | 4 | 11120 |
| 618 | R | S | L | L | E | P | L | G | L | H | 4 | 11121 |
| 624 | L | G | L | H | C | V | F | I | D | D | 4 | 11122 |
| 638 | H | M | L | H | G | E | V | H | C | G | 4 | 11123 |
| 655 | F | S | F | K | W | W | N | M | V | P | 4 | 11124 |
| 4 | Q | R | I | V | R | V | S | L | P | H | 3 | 11125 |
| 11 | L | E | H | P | T | S | A | V | C | V | 3 | 11126 |
| 13 | H | P | V | S | A | V | C | V | A | G | 3 | 11127 |
| 48 | V | D | I | Y | I | S | P | N | M | E | 3 | 11128 |
| 54 | P | N | M | E | R | G | P | E | P | A | 3 | 11129 |
| 56 | M | E | R | G | R | E | R | A | D | T | 3 | 11130 |
| 58 | R | G | R | E | R | A | D | T | R | R | 3 | 11131 |
| 80 | M | N | S | P | S | N | D | L | N | D | 3 | 11132 |
| 83 | P | S | N | D | L | N | D | S | H | V | 3 | 11133 |
| 115 | V | D | I | S | L | D | C | D | L | N | 3 | 11134 |
| 123 | L | N | C | E | G | P | Q | D | R | N | 3 | 11135 |
| 131 | R | N | F | V | D | K | R | Q | W | V | 3 | 11136 |
| 152 | V | N | C | D | R | D | D | P | S | C | 3 | 11137 |
| 201 | L | H | T | S | S | Y | D | A | K | P | 3 | 11138 |
| 204 | S | S | Y | D | A | K | R | A | Q | V | 3 | 11139 |
| 206 | Y | D | A | K | P | A | Q | V | F | H | 3 | 11140 |
| 235 | V | S | Y | E | V | P | P | L | H | G | 3 | 11141 |
| 257 | P | D | A | G | F | T | G | L | I | S | 3 | 11142 |
| 272 | L | D | D | S | N | E | D | F | S | A | 3 | 11143 |
| 293 | V | A | P | W | I | M | V | P | S | T | 3 | 11144 |
| 331 | G | C | K | L | V | I | C | P | Q | A | 3 | 11145 |
| 336 | I | C | P | Q | A | P | N | P | N | D | 3 | 11146 |
| 352 | M | E | L | G | Y | V | Q | A | P | H | 3 | 11147 |
| 357 | V | Q | A | P | H | K | T | L | P | V | 3 | 11148 |
| 393 | T | R | E | P | R | D | P | S | V | S | 3 | 11149 |
| 394 | P | E | P | P | D | P | S | V | S | G | 3 | 11150 |
| 408 | G | N | L | E | V | S | P | P | V | V | 3 | 11151 |
| 432 | G | N | L | P | G | S | S | G | P | P | 3 | 11152 |
| 446 | V | R | D | F | L | H | A | Q | K | V | 3 | 11153 |
| 450 | L | H | A | Q | K | V | Q | P | P | V | 3 | 11154 |
| 475 | L | S | F | V | P | A | P | D | G | K | 3 | 11155 |
| 478 | V | P | A | P | D | G | K | G | F | P | 3 | 11156 |
| 501 | Q | E | G | Q | K | C | G | H | G | R | 3 | 11157 |
| 518 | V | D | D | E | Q | V | K | T | I | S | 3 | 11158 |
| 533 | S | N | K | D | L | I | N | Y | N | K | 3 | 11159 |
| 573 | F | K | T | E | R | K | K | A | T | A | 3 | 11160 |
| 595 | K | H | L | G | I | P | K | P | F | G | 3 | 11161 |
| 599 | I | P | K | P | F | G | P | I | I | N | 3 | 11162 |
| 7 | V | R | V | S | L | E | H | P | T | S | 2 | 11163 |
| 16 | S | A | V | C | V | A | G | V | E | T | 2 | 11164 |
| 43 | Y | G | T | P | G | V | D | I | Y | I | 2 | 11165 |
| 52 | I | S | P | N | M | E | R | G | R | E | 2 | 11166 |
| 85 | N | D | L | N | D | S | H | V | Q | I | 2 | 11167 |
| 95 | S | Y | H | S | S | H | E | P | L | P | 2 | 11168 |
| 100 | H | E | P | L | P | L | A | Y | A | V | 2 | 11169 |
| 119 | L | D | C | D | L | N | C | E | G | R | 2 | 11170 |
| 136 | K | R | Q | W | V | W | G | P | S | G | 2 | 11171 |
| 147 | G | G | I | L | L | V | N | C | D | R | 2 | 11172 |
| 153 | N | C | D | R | D | D | P | S | C | D | 2 | 11173 |
| 161 | C | D | V | Q | D | N | C | D | Q | H | 2 | 11174 |
| 164 | Q | D | N | C | D | Q | H | V | H | C | 2 | 11175 |
| 166 | N | C | D | Q | H | V | H | C | L | Q | 2 | 11176 |
| 172 | H | C | L | Q | D | L | E | D | M | S | 2 | 11177 |
| 189 | G | P | A | A | L | F | D | D | H | K | 2 | 11178 |
| 209 | K | R | A | Q | V | F | H | I | C | G | 2 | 11179 |
| 214 | F | H | I | C | G | P | E | D | V | C | 2 | 11180 |
| 218 | G | P | E | D | V | C | E | A | Y | R | 2 | 11181 |
| 219 | P | E | D | V | C | E | A | Y | R | H | 2 | 11182 |
| 230 | Y | E | V | S | Y | E | V | P | R | L | H | G | D | E | 2 | 11185 |
| 232 | Q | D | K | V | S | Y | E | V | P | R | 2 | 11184 |
| 237 | Y | E | V | P | R | L | H | G | D | E | 2 | 11185 |
| 275 | S | N | E | D | F | S | A | S | P | I | 2 | 11186 |
| 280 | S | A | S | P | I | F | T | D | T | V | 2 | 11187 |
| 286 | T | D | T | V | V | F | R | V | A | P | 2 | 11188 |
| 295 | P | W | I | M | T | P | S | T | L | P | 2 | 11189 |
| 306 | L | S | V | Y | V | C | R | V | R | N | 2 | 11190 |
| 323 | V | A | E | L | A | R | K | A | G | C | 2 | 11191 |
| 332 | C | K | L | T | I | C | P | Q | A | E | 2 | 11192 |
| 364 | L | P | V | V | F | D | S | P | R | N | 2 | 11193 |
| 368 | F | D | S | P | R | N | G | S | L | Q | 2 | 11194 |
| 371 | P | R | N | G | S | L | Q | D | F | P | 2 | 11195 |
| 374 | G | E | L | Q | D | F | P | Y | K | R | 2 | 11196 |
| 389 | F | G | Y | V | T | R | E | P | R | D | 2 | 11197 |
| 399 | R | S | V | S | G | L | D | S | F | G | 2 | 11198 |
| 413 | S | P | P | V | V | A | N | G | K | E | 2 | 11199 |
| 418 | A | N | G | K | E | Y | P | L | G | R | 2 | 11200 |
| 421 | K | E | Y | P | L | G | R | I | L | I | 2 | 11201 |
| 426 | G | R | I | L | I | G | G | N | L | P | 2 | 11202 |
| 430 | I | G | G | N | L | P | G | S | S | G | 2 | 11203 |
| 431 | G | G | N | L | P | G | S | S | G | R | 2 | 11204 |
| 435 | P | G | S | S | G | R | R | V | T | Q | 2 | 11205 |
| 447 | R | D | F | L | H | A | Q | K | V | Q | 2 | 11206 |
| 451 | H | A | Q | K | V | Q | P | P | V | E | 2 | 11207 |
| 486 | F | R | M | L | L | A | S | P | G | A | 2 | 11208 |
| 497 | F | K | L | F | Q | E | K | Q | K | C | 2 | 11209 |
| 500 | F | Q | E | K | Q | K | C | G | H | G | 2 | 11210 |
| 539 | N | Y | N | K | F | V | Q | S | C | I | 2 | 11211 |
| 541 | N | K | F | V | Q | S | C | I | D | W | 2 | 11212 |
| 557 | R | E | L | G | L | A | E | C | D | I | 2 | 11213 |
| 610 | C | C | C | L | E | E | K | V | R | S | 2 | 11214 |
| 637 | Y | H | M | L | H | G | E | V | H | C | 2 | 11215 |
| 640 | L | H | G | E | V | H | C | G | T | N | 2 | 11216 |
| 650 | V | C | R | K | P | F | S | F | K | W | 2 | 11217 |
| 15 | T | S | A | V | C | V | A | G | V | E | 1 | 11218 |
| 29 | I | Y | G | S | V | P | S | G | T | E | 1 | 11219 |
| 53 | S | P | N | M | E | R | G | R | E | R | 1 | 11220 |
| 55 | N | M | E | R | G | R | E | R | A | D | 1 | 11221 |
| 59 | G | R | E | R | A | D | T | R | R | W | 1 | 11222 |
| 62 | R | A | D | T | R | R | W | R | F | D | 1 | 11223 |
| 67 | R | W | R | F | D | A | T | L | E | I | 1 | 11224 |
| 79 | V | M | N | S | P | S | N | D | L | N | 1 | 11225 |
| 82 | S | P | S | N | D | L | N | D | S | H | 1 | 11226 |
| 84 | S | N | D | L | N | D | S | H | V | Q | 1 | 11227 |
| 121 | C | D | L | N | C | E | G | R | Q | D | 1 | 11228 |
| 129 | Q | D | R | N | F | V | D | K | R | Q | 1 | 11229 |
| 154 | C | D | R | D | D | P | S | C | D | V | 1 | 11230 |
| 159 | P | S | C | D | V | Q | D | N | C | D | 1 | 11231 |
| 160 | S | C | D | V | Q | D | N | C | D | Q | 1 | 11232 |
| 163 | V | Q | D | N | C | D | Q | H | V | H | 1 | 11233 |
| 167 | C | D | Q | H | V | H | C | L | Q | D | 1 | 11234 |
| 180 | M | S | V | M | V | L | R | T | Q | G | 1 | 11235 |
| 203 | T | S | S | Y | D | A | K | R | A | Q | 1 | 11236 |
| 222 | V | C | S | A | Y | R | H | V | L | G | 1 | 11237 |
| 225 | A | Y | R | H | V | L | G | Q | D | K | 1 | 11238 |
| 226 | Y | R | H | V | L | G | Q | D | K | V | 1 | 11239 |
| 239 | V | P | R | L | H | G | D | E | E | R | 1 | 11240 |
| 242 | L | H | G | D | E | E | R | F | V | L | 1 | 11241 |
| 251 | V | E | G | L | S | F | P | D | A | G | 1 | 11242 |
| 256 | F | P | D | A | G | F | T | G | L | I | 1 | 11243 |
| 267 | F | H | V | T | L | L | D | D | S | N | 1 | 11244 |
| 281 | A | S | P | I | F | T | D | T | V | V | 1 | 11245 |
| 299 | T | P | S | T | L | P | P | L | E | V | 1 | 11246 |
| 308 | V | Y | V | C | R | V | R | N | N | T | 1 | 11247 |
| 315 | N | N | T | C | F | V | D | A | V | A | 1 | 11248 |
| 326 | L | A | R | K | A | G | C | K | L | T | 1 | 11249 |
| 327 | A | R | K | A | G | C | K | L | T | I | 1 | 11250 |
| 344 | N | D | R | W | I | Q | D | E | M | E | 1 | 11251 |
| 354 | L | G | Y | V | Q | A | P | H | K | T | 1 | 11252 |
| 396 | P | R | D | R | S | V | S | G | L | D | 1 | 11253 |
| 397 | R | D | R | S | V | S | G | L | D | S | 1 | 11254 |

TABLE XL-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 402 | S | G | L | D | S | F | G | N | L | E | 1 | 11255 |
| 407 | F | G | N | L | E | V | S | P | P | V | 1 | 11256 |
| 434 | L | P | G | S | S | G | R | R | V | T | 1 | 11257 |
| 437 | S | S | G | R | R | V | T | Q | V | V | 1 | 11258 |
| 438 | S | G | R | R | V | T | Q | V | V | R | 1 | 11259 |
| 459 | V | E | L | F | V | D | W | L | A | V | 1 | 11260 |
| 487 | R | M | L | L | A | S | P | G | A | C | 1 | 11261 |
| 509 | G | R | A | L | L | F | Q | G | V | V | 1 | 11262 |
| 510 | R | A | L | L | F | Q | G | V | V | D | 1 | 11263 |
| 514 | F | Q | G | V | V | D | D | E | Q | V | 1 | 11264 |
| 515 | Q | G | V | V | D | D | E | Q | V | K | 1 | 11265 |
| 540 | Y | N | K | F | V | Q | S | C | I | D | 1 | 11266 |
| 544 | V | Q | S | C | I | D | W | N | R | E | 1 | 11267 |
| 545 | Q | S | C | I | D | W | N | R | E | V | 1 | 11268 |
| 562 | A | E | C | D | I | I | D | I | P | Q | 1 | 11269 |
| 569 | I | P | Q | L | F | K | T | E | R | K | 1 | 11270 |
| 570 | P | Q | L | F | K | T | E | R | K | K | 1 | 11271 |
| 603 | F | G | P | I | I | N | G | C | C | C | 1 | 11272 |
| 608 | N | G | C | C | C | L | E | E | K | V | 1 | 11273 |
| 613 | L | E | E | K | V | R | S | L | L | E | 1 | 11274 |
| 635 | T | P | Y | H | M | L | H | G | E | V | 1 | 11275 |
| 641 | H | G | E | V | H | C | G | T | N | V | 1 | 11276 |
| 645 | H | C | G | T | N | V | C | R | K | P | 1 | 11277 |
| 652 | R | K | P | F | S | F | K | W | W | N | 1 | 11278 |

184P1E2 v.2: HLA Peptide Scoring Results A26 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 3 | I | M | T | P | S | T | L | A | P | L | 15 | 11279 |
| 8 | T | L | A | P | L | E | V | Y | V | C | 15 | 11280 |
| 6 | P | S | T | L | A | P | L | E | V | Y | 14 | 11281 |
| 4 | M | T | P | S | T | L | A | P | L | E | 13 | 11282 |
| 2 | W | I | M | T | P | S | T | L | A | P | 11 | 11283 |
| 7 | S | T | L | A | P | L | E | V | Y | V | 11 | 11284 |
| 10 | A | P | L | E | V | Y | V | C | R | V | 7 | 11285 |
| 9 | L | A | P | L | E | V | Y | V | C | R | 6 | 11286 |
| 1 | P | W | I | M | T | P | S | T | L | A | 2 | 11287 |
| 5 | T | P | S | T | L | A | P | L | E | V | 1 | 11288 |

184P1E2 v.3: HLA Peptide Scoring Results A26 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 7 | F | V | P | V | P | D | G | K | G | F | 22 | 11289 |
| 9 | P | V | P | D | G | K | G | F | R | M | 21 | 11290 |
| 10 | V | P | D | G | K | G | F | R | M | L | 16 | 11291 |
| 3 | E | F | L | S | F | V | P | V | P | D | 14 | 11292 |
| 2 | D | E | F | L | S | F | V | P | V | P | 13 | 11293 |
| 4 | F | L | S | F | V | P | V | P | D | G | 13 | 11294 |
| 6 | S | F | V | P | V | P | D | G | K | G | 9 | 11295 |
| 1 | V | D | E | F | L | S | F | V | P | V | 5 | 11296 |
| 5 | L | S | F | V | P | V | P | D | G | K | 3 | 11297 |
| 8 | V | P | V | P | D | G | K | G | F | R | 2 | 11298 |

TABLE XLI

| Pos | 1 | 2 | 3 | 4 | 5 | 6 | 7 | 8 | 9 | 0 | score | SEQ. ID NO. |
|---|---|---|---|---|---|---|---|---|---|---|---|---|

184P1E2 v.1: HLA Peptide Scoring Results B 0702 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 480 | A | P | D | G | K | G | F | R | M | L | 26 | 11299 |
| 101 | E | P | L | P | L | A | Y | A | V | L | 24 | 11300 |
| 103 | L | P | L | A | Y | A | V | L | Y | L | 24 | 11301 |
| 142 | G | P | S | G | Y | G | G | I | L | L | 24 | 11302 |
| 395 | E | P | R | D | R | S | V | S | G | L | 24 | 11303 |
| 584 | F | P | D | L | V | N | M | L | V | L | 24 | 11304 |
| 294 | A | P | W | I | M | T | P | S | T | L | 22 | 11305 |
| 359 | A | P | H | K | T | L | P | V | V | F | 22 | 11306 |
| 457 | P | P | V | E | L | F | V | D | W | L | 21 | 11307 |
| 622 | P | P | L | G | L | H | C | T | F | I | 21 | 11308 |
| 282 | S | P | I | F | T | D | T | V | V | F | 20 | 11309 |
| 299 | T | P | S | T | L | P | P | L | B | V | 20 | 11310 |
| 604 | G | P | I | I | N | G | C | C | C | L | 20 | 11311 |
| 256 | F | P | D | A | G | F | T | G | L | I | 19 | 11312 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 434 | L | P | G | S | S | G | R | R | V | T | 19 | 11313 |
| 33 | V | P | H | G | T | E | M | F | B | V | 18 | 11314 |
| 370 | S | P | R | N | G | E | L | Q | D | F | 18 | 11315 |
| 304 | P | P | L | E | V | Y | V | C | R | V | 17 | 11316 |
| 653 | K | P | F | S | F | K | W | W | N | M | 17 | 11317 |
| 635 | T | P | Y | H | M | L | H | G | B | V | 16 | 11318 |
| 96 | Y | H | S | S | H | H | P | L | P | L | 15 | 11319 |
| 192 | A | L | F | D | D | H | K | L | V | L | 15 | 11320 |
| 492 | S | P | G | A | C | F | K | L | F | Q | 15 | 11321 |
| 184 | V | L | R | T | Q | G | P | A | A | L | 14 | 11322 |
| 297 | I | H | T | P | S | T | L | P | P | L | 14 | 11323 |
| 452 | A | Q | K | V | Q | P | P | V | H | L | 14 | 11324 |
| 504 | Q | K | C | G | H | G | R | A | L | L | 14 | 11325 |
| 578 | K | K | A | T | A | F | F | P | D | L | 14 | 11326 |
| 582 | A | F | F | P | D | L | V | N | M | L | 14 | 11327 |
| 617 | V | R | S | L | L | H | P | L | G | L | 14 | 11328 |
| 2 | S | L | Q | R | I | V | R | V | S | L | 13 | 11329 |
| 13 | H | P | T | S | A | V | C | V | A | G | 13 | 11330 |
| 17 | A | V | C | V | A | G | V | E | T | L | 13 | 11331 |
| 65 | T | R | R | W | R | F | D | A | T | L | 13 | 11332 |
| 386 | G | P | D | F | G | Y | V | T | R | E | 13 | 11333 |
| 441 | R | V | T | Q | V | V | R | D | P | L | 13 | 11334 |
| 456 | Q | P | P | V | E | L | F | V | D | W | 13 | 11335 |
| 466 | L | A | V | G | H | V | D | E | F | L | 13 | 11336 |
| 478 | V | P | A | P | D | G | K | G | F | R | 13 | 11337 |
| 481 | P | D | G | K | G | F | R | M | L | L | 13 | 11338 |
| 490 | L | A | S | P | G | A | C | F | K | L | 13 | 11339 |
| 552 | R | E | V | L | K | R | E | L | G | L | 13 | 11340 |
| 563 | E | C | D | I | I | D | I | P | Q | L | 13 | 11341 |
| 601 | K | P | F | G | P | I | I | N | G | C | 13 | 11342 |
| 56 | M | H | G | R | E | R | A | D | T | L | 12 | 11343 |
| 67 | R | W | R | F | D | A | T | L | E | I | 12 | 11344 |
| 82 | S | P | S | N | D | L | N | D | S | H | 12 | 11345 |
| 94 | I | S | Y | H | S | S | H | H | P | L | 12 | 11346 |
| 158 | D | P | S | C | D | V | Q | D | N | C | 12 | 11347 |
| 176 | D | L | E | D | M | S | V | M | V | L | 12 | 11348 |
| 189 | G | P | A | A | L | F | D | D | H | K | 12 | 11349 |
| 221 | D | V | C | E | A | Y | R | H | V | L | 12 | 11350 |
| 233 | D | K | V | S | Y | E | V | P | R | L | 12 | 11351 |
| 239 | V | P | R | L | H | G | D | H | H | R | 12 | 11352 |
| 255 | S | F | P | D | A | G | F | T | G | L | 12 | 11353 |
| 262 | T | G | L | I | S | F | H | V | T | L | 12 | 11354 |
| 263 | G | L | I | S | F | H | V | T | L | L | 12 | 11355 |
| 303 | L | P | P | L | E | V | Y | V | C | R | 12 | 11356 |
| 317 | T | C | F | V | D | A | V | A | H | L | 12 | 11357 |
| 325 | E | L | A | R | K | A | G | C | K | L | 12 | 11358 |
| 337 | C | P | Q | A | E | N | R | N | D | R | 12 | 11359 |
| 357 | V | Q | A | P | H | K | T | L | P | V | 12 | 11360 |
| 379 | F | P | Y | K | R | I | L | G | P | D | 12 | 11361 |
| 401 | V | S | G | L | D | S | F | G | N | L | 12 | 11362 |
| 416 | V | V | A | N | G | K | H | Y | P | L | 12 | 11363 |
| 423 | Y | P | L | G | R | I | L | I | G | G | 12 | 11364 |
| 425 | L | G | R | I | L | I | G | G | N | L | 12 | 11365 |
| 436 | G | S | S | G | R | R | V | T | Q | V | 12 | 11366 |
| 503 | K | Q | K | C | G | H | G | R | A | L | 12 | 11367 |
| 546 | S | C | I | D | W | N | R | E | V | L | 12 | 11368 |
| 550 | W | N | R | E | V | L | K | R | E | L | 12 | 11369 |
| 569 | I | P | Q | L | F | K | T | H | R | K | 12 | 11370 |
| 575 | E | R | K | K | A | T | A | F | F | F | 12 | 11371 |
| 599 | I | P | K | F | G | P | I | I | N | N | 12 | 11372 |
| 615 | H | K | V | R | S | L | L | H | P | L | 12 | 11373 |
| 631 | I | D | D | F | T | P | Y | H | M | L | 12 | 11374 |
| 14 | P | T | S | A | V | C | V | A | G | V | 11 | 11375 |
| 41 | E | V | Y | G | T | P | G | V | D | I | 11 | 11376 |
| 45 | T | P | G | V | D | I | Y | I | S | P | 11 | 11377 |
| 78 | V | V | M | N | S | P | S | N | D | L | 11 | 11378 |
| 114 | C | D | I | S | L | D | C | D | L | L | 11 | 11379 |
| 165 | D | N | C | D | Q | H | V | H | C | L | 11 | 11380 |
| 178 | E | D | H | S | V | M | V | L | R | T | 11 | 11381 |
| 190 | P | A | A | L | F | D | D | H | K | L | 11 | 11382 |
| 218 | G | P | E | D | V | C | E | A | Y | R | 11 | 11383 |
| 245 | D | H | E | R | F | F | E | Q | L | I | 11 | 11384 |
| 327 | A | R | K | A | G | C | K | L | T | I | 11 | 11385 |
| 364 | L | P | V | V | F | D | S | P | R | N | 11 | 11386 |
| 367 | V | F | D | S | P | R | N | G | H | L | 11 | 11387 |
| 376 | L | Q | D | F | P | Y | K | R | I | L | 11 | 11388 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 454 | S | K | V | Q | P | P | V | E | L | F | 11 | 11389 |
| 491 | A | S | P | G | A | C | F | K | L | F | 11 | 11390 |
| 523 | V | K | T | I | S | I | N | Q | V | L | 11 | 11391 |
| 528 | I | N | Q | V | L | S | N | K | D | L | 11 | 11392 |
| 588 | V | N | M | L | V | L | G | K | H | L | 11 | 11393 |
| 611 | C | C | L | E | E | K | V | R | S | L | 11 | 11394 |
| 612 | C | L | E | E | K | V | R | S | L | L | 11 | 11395 |
| 6 | I | V | R | V | S | L | E | H | P | T | 10 | 11396 |
| 8 | R | V | S | L | H | H | P | T | S | A | 10 | 11397 |
| 53 | S | P | N | H | H | R | G | R | H | R | 10 | 11398 |
| 64 | D | T | R | R | W | R | F | D | A | T | 10 | 11399 |
| 106 | A | Y | A | V | L | Y | L | T | C | V | 10 | 11400 |
| 108 | A | V | L | Y | L | T | C | V | D | I | 10 | 11401 |
| 110 | L | Y | L | T | C | V | D | I | S | L | 10 | 11402 |
| 141 | W | G | P | S | G | Y | G | G | I | L | 10 | 11403 |
| 168 | D | Q | H | V | H | C | L | Q | D | L | 10 | 11404 |
| 194 | F | D | D | H | K | L | V | L | H | T | 10 | 11405 |
| 216 | I | C | G | P | H | D | V | C | H | A | 10 | 11406 |
| 241 | R | L | H | G | D | E | E | R | F | F | 10 | 11407 |
| 250 | F | V | H | G | L | S | F | P | D | A | 10 | 11408 |
| 280 | S | A | S | P | I | P | T | D | T | V | 10 | 11409 |
| 281 | A | S | P | I | F | T | D | T | V | V | 10 | 11410 |
| 345 | D | R | W | I | Q | D | E | M | E | L | 10 | 11411 |
| 355 | G | Y | V | Q | A | P | H | K | T | L | 10 | 11412 |
| 383 | R | I | L | G | P | P | D | F | G | Y | V | 10 | 11413 |
| 384 | I | L | G | P | P | D | F | G | Y | V | T | 10 | 11414 |
| 413 | S | P | P | V | V | A | N | C | K | E | 10 | 11415 |
| 414 | P | P | V | V | A | N | G | K | H | Y | 10 | 11416 |
| 420 | G | K | E | Y | P | L | G | R | I | L | 10 | 11417 |
| 471 | V | D | H | F | L | S | F | V | P | A | 10 | 11418 |
| 482 | D | G | K | G | F | R | M | L | L | A | 10 | 11419 |
| 505 | K | C | G | H | G | R | A | L | L | F | 10 | 11420 |
| 508 | H | G | R | A | L | L | F | Q | G | V | 10 | 11421 |
| 11 | L | H | H | P | T | S | A | V | C | V | 9 | 11422 |
| 12 | E | H | P | T | S | A | V | C | V | A | 9 | 11423 |
| 20 | V | A | G | V | E | T | L | V | D | I | 9 | 11424 |
| 30 | Y | G | S | V | P | E | G | T | E | M | 9 | 11425 |
| 61 | E | R | A | D | T | R | R | W | R | F | 9 | 11426 |
| 63 | A | D | T | R | R | W | R | F | D | A | 9 | 11427 |
| 69 | R | F | D | A | T | L | E | I | I | V | 9 | 11428 |
| 71 | D | A | T | L | E | I | I | V | V | M | 9 | 11429 |
| 97 | H | S | S | H | E | P | L | P | L | A | 9 | 11430 |
| 125 | C | H | G | R | Q | D | P | N | F | V | 9 | 11431 |
| 143 | P | S | G | Y | G | G | I | L | L | V | 9 | 11432 |
| 205 | S | Y | D | A | K | R | A | Q | V | F | 9 | 11433 |
| 242 | L | H | G | D | E | E | R | F | F | V | 9 | 11434 |
| 247 | E | R | F | F | V | E | G | L | S | F | 9 | 11435 |
| 253 | G | L | S | F | P | D | A | G | F | T | 9 | 11436 |
| 261 | F | T | G | L | I | S | F | H | V | T | 9 | 11437 |
| 279 | F | S | A | S | P | I | F | T | D | T | 9 | 11438 |
| 285 | F | T | D | T | V | F | R | V | A | 9 | 11439 |
| 301 | S | T | L | P | P | L | E | V | Y | V | 9 | 11440 |
| 310 | V | C | R | V | R | N | N | T | C | F | 9 | 11441 |
| 313 | V | R | N | N | T | C | F | V | D | A | 9 | 11442 |
| 314 | R | N | N | T | C | F | V | D | A | V | 9 | 11443 |
| 326 | L | A | R | K | A | G | C | K | L | T | 9 | 11444 |
| 350 | D | E | M | E | L | G | Y | V | Q | A | 9 | 11445 |
| 403 | G | L | D | S | F | G | N | L | H | V | 9 | 11446 |
| 409 | N | L | E | V | S | P | P | V | V | A | 9 | 11447 |
| 421 | K | H | Y | P | L | G | R | I | L | I | 9 | 11448 |
| 437 | S | S | G | R | R | V | T | Q | V | V | 9 | 11449 |
| 443 | T | Q | V | V | R | D | F | L | H | A | 9 | 11450 |
| 450 | L | H | A | Q | K | V | Q | P | P | V | 9 | 11451 |
| 459 | V | H | L | F | V | D | W | L | A | V | 9 | 11452 |
| 468 | V | G | H | V | D | E | F | L | S | F | 9 | 11453 |
| 557 | R | H | L | G | L | A | E | C | D | I | 9 | 11454 |
| 574 | K | T | E | R | K | K | A | T | A | F | 9 | 11455 |
| 597 | L | G | I | P | K | P | F | G | P | I | 9 | 11456 |
| 9 | V | S | L | E | H | P | T | S | A | V | 8 | 11457 |
| 16 | S | A | V | C | V | A | G | V | H | T | 8 | 11458 |
| 18 | V | C | V | A | G | V | H | T | L | V | 8 | 11459 |
| 28 | D | I | Y | G | S | V | P | H | G | T | 8 | 11460 |
| 31 | G | S | V | P | E | G | T | H | H | F | 8 | 11461 |
| 39 | M | F | H | V | Y | G | T | P | G | V | 8 | 11462 |
| 47 | G | V | D | I | Y | I | S | P | N | M | 8 | 11463 |
| 54 | P | N | M | E | R | G | R | E | R | A | 8 | 11464 |
| 70 | F | D | A | T | L | H | I | I | V | V | 8 | 11465 |
| 85 | N | D | L | N | D | S | H | V | Q | I | 8 | 11466 |
| 99 | S | H | E | P | L | P | L | A | Y | A | 8 | 11467 |
| 124 | N | C | E | G | P | Q | D | R | N | F | 8 | 11468 |
| 131 | R | N | F | V | D | K | R | Q | W | V | 8 | 11469 |
| 140 | V | W | G | P | S | G | Y | G | G | I | 8 | 11470 |
| 154 | C | D | R | D | D | P | S | C | D | V | 8 | 11471 |
| 174 | L | Q | D | L | E | D | M | S | V | M | 8 | 11472 |
| 175 | Q | D | L | E | D | M | S | V | M | V | 8 | 11473 |
| 183 | M | V | L | R | T | Q | G | P | A | A | 8 | 11474 |
| 191 | A | A | L | F | D | D | H | K | L | V | 8 | 11475 |
| 202 | H | T | S | S | Y | D | A | K | R | A | 8 | 11476 |
| 204 | S | S | Y | D | A | K | R | A | Q | V | 8 | 11477 |
| 252 | E | G | L | S | F | P | D | A | G | F | 8 | 11478 |
| 260 | G | F | T | G | L | I | S | F | H | V | 8 | 11479 |
| 276 | N | H | D | F | S | A | S | P | I | F | 8 | 11480 |
| 277 | E | D | F | S | A | S | P | I | F | T | 8 | 11481 |
| 284 | I | F | T | D | T | V | F | R | V | 8 | 11482 |
| 290 | V | F | R | V | A | P | W | I | M | T | 8 | 11483 |
| 293 | V | A | P | W | I | M | T | P | S | T | 8 | 11484 |
| 311 | C | R | V | R | N | N | T | C | F | V | 8 | 11485 |
| 315 | N | N | T | C | F | V | D | A | V | A | 8 | 11486 |
| 343 | R | N | D | R | W | I | Q | D | E | M | 8 | 11487 |
| 348 | I | Q | D | H | M | E | L | G | Y | V | 8 | 11488 |
| 358 | Q | A | P | H | K | T | L | P | V | V | 8 | 11489 |
| 392 | V | T | R | E | P | R | D | R | S | V | 8 | 11490 |
| 398 | D | R | S | V | S | G | L | D | S | F | 8 | 11491 |
| 407 | F | Q | N | L | E | V | S | P | P | V | 8 | 11492 |
| 408 | G | N | L | E | V | S | P | P | V | V | 8 | 11493 |
| 433 | N | I | P | G | S | S | G | R | R | V | 8 | 11494 |
| 440 | R | R | V | T | Q | V | V | R | D | F | 8 | 11495 |
| 462 | F | V | D | W | L | A | V | G | H | V | 8 | 11496 |
| 465 | W | L | A | V | G | H | V | D | H | F | 8 | 11497 |
| 486 | F | R | M | L | L | A | S | P | G | A | 8 | 11498 |
| 488 | M | L | L | A | S | P | G | A | C | F | 8 | 11499 |
| 502 | E | K | Q | K | C | G | H | G | R | A | 8 | 11500 |
| 509 | G | R | A | L | L | F | Q | G | V | V | 8 | 11501 |
| 516 | G | V | V | D | D | E | Q | V | K | T | 8 | 11502 |
| 517 | V | V | D | D | E | Q | V | K | T | I | 8 | 11503 |
| 535 | K | D | L | I | N | Y | N | K | F | V | 8 | 11504 |
| 553 | E | V | L | K | R | E | L | G | L | A | 8 | 11505 |
| 558 | H | L | G | L | A | H | C | D | I | I | 8 | 11506 |
| 566 | I | I | D | I | P | Q | L | F | K | T | 8 | 11507 |
| 571 | Q | L | F | K | T | E | R | K | K | A | 8 | 11508 |
| 579 | K | A | T | A | F | F | P | D | L | V | 8 | 11509 |
| 581 | T | A | F | F | P | D | L | V | N | M | 8 | 11510 |
| 590 | M | L | V | L | G | K | H | L | G | I | 8 | 11511 |
| 598 | G | I | P | K | P | F | G | P | I | I | 8 | 11512 |
| 639 | M | L | H | G | E | V | H | C | G | T | 8 | 11513 |
| 646 | C | G | T | N | V | C | R | K | P | F | 8 | 11514 |
| 654 | P | S | F | K | W | N | M | V | V | 8 | 11515 |
| 19 | C | V | A | G | V | E | T | L | V | D | 7 | 11516 |
| 24 | E | T | L | V | D | I | Y | G | S | V | 7 | 11517 |
| 36 | G | T | E | M | P | E | V | Y | Q | T | 7 | 11518 |
| 43 | Y | G | T | P | G | V | D | I | Y | I | 7 | 11519 |
| 100 | H | H | P | L | P | L | A | Y | A | V | 7 | 11520 |
| 104 | P | L | A | Y | A | V | L | Y | L | T | 7 | 11521 |
| 182 | V | H | V | L | R | T | Q | G | P | A | 7 | 11522 |
| 185 | L | R | T | Q | G | P | A | A | L | F | 7 | 11523 |
| 207 | D | A | K | R | A | Q | V | F | H | I | 7 | 11524 |
| 220 | E | D | V | C | E | A | Y | R | H | V | 7 | 11525 |
| 258 | D | A | G | F | T | G | L | I | S | F | 7 | 11526 |
| 272 | L | D | D | S | N | E | D | F | S | A | 7 | 11527 |
| 275 | S | N | E | D | F | S | A | S | P | I | 7 | 11528 |
| 288 | T | V | V | F | R | V | A | P | W | I | 7 | 11529 |
| 308 | V | Y | V | C | R | V | R | N | N | T | 7 | 11530 |
| 321 | D | A | V | A | E | L | A | R | K | A | 7 | 11531 |
| 331 | G | C | K | L | T | I | C | P | Q | A | 7 | 11532 |
| 375 | E | L | Q | D | F | P | Y | K | R | I | 7 | 11533 |
| 380 | P | Y | K | R | I | L | G | P | D | F | 7 | 11534 |
| 446 | V | R | D | F | L | H | A | Q | K | V | 7 | 11535 |
| 453 | Q | K | V | Q | P | P | V | E | L | F | 7 | 11536 |
| 469 | G | H | V | D | E | F | L | S | F | V | 7 | 11537 |
| 477 | F | V | P | A | P | D | G | K | G | F | 7 | 11538 |
| 514 | F | Q | G | V | V | D | D | E | Q | V | 7 | 11539 |
| 519 | D | D | E | Q | V | K | T | I | S | I | 7 | 11540 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 534 | N | K | D | L | I | N | Y | N | K | F | 7 | 11541 |
| 539 | N | Y | N | K | F | V | Q | S | C | I | 7 | 11542 |
| 560 | G | L | A | E | C | D | I | I | D | I | 7 | 11543 |
| 572 | L | F | K | T | E | R | K | K | A | T | 7 | 11544 |
| 573 | F | K | T | E | R | K | K | A | T | A | 7 | 11545 |
| 594 | G | K | H | L | G | I | P | K | P | F | 7 | 11546 |
| 620 | L | L | E | P | L | G | L | H | C | T | 7 | 11547 |
| 626 | L | H | C | T | F | I | D | D | F | T | 7 | 11548 |
| 630 | F | I | D | Q | F | T | P | Y | H | M | 7 | 11549 |
| 641 | H | G | E | V | H | C | G | T | N | V | 7 | 11550 |
| 68 | W | R | F | D | A | T | L | E | I | I | 6 | 11551 |
| 83 | P | S | N | D | L | N | D | S | H | V | 6 | 11552 |
| 162 | D | V | Q | D | N | C | D | Q | H | V | 6 | 11553 |
| 171 | V | H | C | L | Q | Q | L | E | D | M | 6 | 11554 |
| 173 | C | L | Q | Q | L | E | D | N | S | V | 6 | 11555 |
| 186 | R | T | Q | G | P | A | A | L | F | D | 6 | 11556 |
| 199 | L | V | L | H | T | S | S | Y | D | A | 6 | 11557 |
| 208 | A | K | R | A | Q | V | F | H | I | C | 6 | 11558 |
| 213 | V | F | H | I | C | G | P | E | D | V | 6 | 11559 |
| 226 | Y | R | H | V | L | G | Q | D | K | V | 6 | 11560 |
| 230 | L | G | Q | D | K | V | S | Y | E | V | 6 | 11561 |
| 240 | P | R | L | H | G | D | E | E | R | F | 6 | 11562 |
| 270 | T | L | L | D | D | S | N | E | D | F | 6 | 11563 |
| 289 | V | V | F | R | V | A | P | W | I | M | 6 | 11564 |
| 318 | C | F | V | D | A | V | A | E | L | A | 6 | 11565 |
| 339 | Q | A | E | N | R | N | D | R | W | I | 6 | 11566 |
| 354 | L | G | Y | V | Q | A | P | H | K | T | 6 | 11567 |
| 411 | E | V | S | P | P | V | V | A | N | G | 6 | 11568 |
| 418 | A | N | G | K | E | Y | P | L | G | R | 6 | 11569 |
| 419 | N | Q | K | E | Y | P | L | G | R | I | 6 | 11570 |
| 458 | P | V | E | L | F | V | D | W | L | A | 6 | 11571 |
| 479 | P | A | P | D | G | K | G | F | R | M | 6 | 11572 |
| 522 | Q | V | K | T | I | S | I | N | Q | V | 6 | 11573 |
| 529 | N | Q | V | L | S | N | K | D | L | I | 6 | 11574 |
| 545 | Q | S | C | I | D | W | N | R | E | V | 6 | 11575 |
| 564 | C | D | I | I | D | I | P | Q | L | F | 6 | 11576 |
| 580 | A | T | A | F | F | P | D | L | V | N | 6 | 11577 |
| 583 | F | F | P | D | L | V | N | M | L | V | 6 | 11578 |
| 608 | N | G | C | C | C | L | E | E | K | V | 6 | 11579 |
| 621 | L | H | P | L | G | L | H | C | T | F | 6 | 11580 |
| 625 | G | L | H | C | T | F | I | D | D | F | 6 | 11581 |
| 648 | T | N | V | C | R | K | P | F | S | F | 6 | 11582 |
| 60 | R | E | R | A | D | T | R | R | W | R | 5 | 11583 |
| 72 | A | T | L | E | I | I | V | V | N | N | 5 | 11584 |
| 80 | M | N | S | P | S | N | D | L | N | O | 5 | 11585 |
| 144 | S | G | Y | G | G | I | L | L | V | N | 5 | 11586 |
| 145 | G | Y | G | G | I | L | L | V | N | C | 5 | 11587 |
| 156 | R | D | D | P | S | C | D | V | Q | D | 5 | 11588 |
| 206 | Y | D | A | K | R | A | Q | V | F | H | 5 | 11589 |
| 257 | P | D | A | G | F | T | G | L | I | S | 5 | 11590 |
| 264 | L | I | S | F | H | V | T | L | L | D | 5 | 11591 |
| 292 | R | V | A | P | W | I | M | T | P | S | 5 | 11592 |
| 296 | W | I | M | T | P | S | T | L | P | P | 5 | 11593 |
| 319 | F | V | D | A | V | A | E | L | A | R | 5 | 11594 |
| 322 | A | V | A | E | L | A | R | K | A | G | 5 | 11595 |
| 328 | R | K | A | G | C | K | L | T | I | C | 5 | 11596 |
| 397 | R | D | R | S | V | S | G | L | D | S | 5 | 11597 |
| 435 | P | G | S | S | G | R | R | V | T | Q | 5 | 11598 |
| 438 | S | G | R | R | V | T | Q | V | V | R | 5 | 11599 |
| 430 | G | R | R | V | T | Q | V | V | R | D | 5 | 11600 |
| 506 | C | G | H | G | R | A | L | L | F | Q | 5 | 11601 |
| 511 | A | L | L | F | Q | G | V | V | D | D | 5 | 11602 |
| 525 | T | I | S | I | N | Q | V | L | S | N | 5 | 11603 |
| 595 | K | H | L | G | I | P | K | P | F | G | 5 | 11604 |
| 606 | I | I | N | G | C | C | C | L | E | E | 5 | 11605 |
| 26 | L | V | D | I | Y | G | S | V | P | E | 4 | 11606 |
| 58 | R | G | F | E | R | A | D | T | R | R | 4 | 11607 |
| 116 | D | I | S | L | D | C | D | L | N | C | 4 | 11608 |
| 126 | E | G | R | Q | D | R | N | F | V | D | 4 | 11609 |
| 133 | F | V | D | K | R | Q | W | V | W | G | 4 | 11610 |
| 215 | H | I | C | G | P | E | D | V | C | E | 4 | 11611 |
| 223 | C | H | A | Y | R | H | V | L | G | Q | 4 | 11612 |
| 225 | A | Y | R | H | V | L | G | Q | D | K | 4 | 11613 |
| 228 | H | V | L | G | Q | D | K | V | S | Y | 4 | 11614 |
| 273 | D | D | S | N | E | D | F | S | A | S | 4 | 11615 |
| 283 | P | I | F | T | D | T | V | V | F | R | 4 | 11616 |
| 286 | T | D | T | V | V | F | R | V | A | P | 4 | 11617 |
| 312 | R | V | R | N | N | T | C | F | V | D | 4 | 11618 |
| 330 | A | G | C | K | L | T | I | C | P | Q | 4 | 11619 |
| 352 | M | H | L | G | Y | V | Q | A | P | H | 4 | 11620 |
| 360 | P | H | K | T | L | P | V | V | F | D | 4 | 11621 |
| 400 | S | V | S | G | L | D | S | F | G | N | 4 | 11622 |
| 405 | D | S | F | G | N | L | E | V | S | P | 4 | 11623 |
| 410 | L | H | V | S | P | P | V | V | A | N | 4 | 11624 |
| 427 | R | I | L | I | G | G | N | L | P | G | 4 | 11625 |
| 428 | I | L | I | G | G | N | L | P | G | S | 4 | 11626 |
| 483 | G | K | G | F | R | M | L | L | A | S | 4 | 11627 |
| 510 | R | A | L | L | F | Q | G | V | V | D | 4 | 11628 |
| 548 | I | D | W | N | R | E | V | L | K | R | 4 | 11629 |
| 577 | R | K | K | A | T | A | F | F | P | D | 4 | 11630 |
| 616 | K | V | R | S | L | L | E | P | L | G | 4 | 11631 |
| 3 | L | Q | R | I | V | R | V | S | L | E | 3 | 11632 |
| 21 | A | G | V | E | T | L | V | D | I | Y | 3 | 11633 |
| 34 | P | H | G | T | E | M | F | E | V | Y | 3 | 11634 |
| 35 | E | G | T | E | M | F | E | V | Y | G | 3 | 11635 |
| 38 | E | N | F | E | V | Y | G | T | P | G | 3 | 11636 |
| 51 | Y | I | S | P | N | M | E | R | G | R | 3 | 11637 |
| 62 | R | A | D | T | R | R | W | R | F | D | 3 | 11638 |
| 98 | S | S | H | E | P | L | P | L | A | Y | 3 | 11639 |
| 105 | L | A | Y | A | V | L | Y | L | T | C | 3 | 11640 |
| 127 | G | R | Q | D | R | N | F | V | D | K | 3 | 11641 |
| 128 | R | Q | D | R | N | F | V | D | K | R | 3 | 11642 |
| 135 | D | K | R | Q | W | V | W | G | P | S | 3 | 11643 |
| 177 | L | H | D | M | S | V | M | V | L | R | 3 | 11644 |
| 193 | L | F | D | D | H | K | L | V | L | H | 3 | 11645 |
| 203 | T | S | S | Y | D | A | K | R | A | Q | 3 | 11646 |
| 211 | A | Q | V | F | H | I | C | G | P | E | 3 | 11647 |
| 222 | V | C | E | A | Y | R | H | V | L | G | 3 | 11648 |
| 231 | G | Q | D | K | V | S | Y | E | V | P | 3 | 11649 |
| 231 | Q | D | K | V | S | Y | E | V | P | R | 3 | 11650 |
| 232 | K | V | S | Y | E | V | P | R | L | H | 3 | 11651 |
| 235 | V | S | Y | H | V | P | R | L | H | G | 3 | 11652 |
| 243 | H | G | D | E | E | R | F | F | V | E | 3 | 11653 |
| 244 | G | D | E | E | R | F | F | V | E | G | 3 | 11654 |
| 246 | E | H | R | F | F | V | E | G | L | S | 3 | 11655 |
| 259 | A | G | F | T | G | L | I | S | F | H | 3 | 11656 |
| 265 | I | S | F | H | V | T | L | L | D | D | 3 | 11657 |
| 278 | D | F | S | A | S | P | I | F | T | D | 3 | 11658 |
| 287 | D | T | V | V | F | R | V | A | P | W | 3 | 11659 |
| 302 | T | L | P | P | L | E | V | Y | V | C | 3 | 11660 |
| 306 | L | H | V | Y | V | C | R | V | R | N | 3 | 11661 |
| 316 | N | T | C | F | V | D | A | V | A | E | 3 | 11662 |
| 324 | A | H | L | A | R | K | A | G | C | K | 3 | 11663 |
| 329 | K | A | G | C | K | L | T | I | C | P | 3 | 11664 |
| 340 | A | H | N | R | N | D | R | W | I | Q | 3 | 11665 |
| 341 | E | N | R | N | D | R | W | I | Q | D | 3 | 11666 |
| 351 | E | M | E | L | G | Y | V | Q | A | P | 3 | 11667 |
| 353 | E | L | G | Y | V | Q | A | P | H | K | 3 | 11668 |
| 362 | K | T | L | P | V | V | F | D | S | P | 3 | 11669 |
| 368 | F | D | S | P | R | N | G | E | L | Q | 3 | 11670 |
| 371 | P | R | N | G | E | L | Q | D | F | P | 3 | 11671 |
| 372 | R | N | G | E | L | Q | D | F | P | Y | 3 | 11672 |
| 381 | Y | K | R | I | L | G | P | D | F | G | 3 | 11673 |
| 387 | P | D | F | G | Y | V | T | R | H | P | 3 | 11674 |
| 388 | D | F | G | Y | V | T | R | E | P | R | 3 | 11675 |
| 393 | T | R | E | P | R | D | R | S | V | S | 3 | 11676 |
| 394 | R | H | P | R | D | R | S | V | S | G | 3 | 11677 |
| 404 | L | D | S | F | G | N | L | E | V | S | 3 | 11678 |
| 406 | S | F | G | N | L | E | V | S | P | P | 3 | 11679 |
| 417 | V | A | N | G | K | E | Y | P | L | G | 3 | 11680 |
| 422 | E | Y | P | L | G | R | I | L | I | G | 3 | 11681 |
| 429 | L | I | G | G | N | L | P | G | S | S | 3 | 11682 |
| 445 | V | V | R | D | F | L | H | A | Q | K | 3 | 11683 |
| 449 | F | L | H | A | Q | K | V | Q | P | P | 3 | 11684 |
| 451 | H | A | Q | K | V | Q | P | P | V | E | 3 | 11685 |
| 460 | E | L | F | V | D | W | L | A | V | G | 3 | 11686 |
| 464 | D | W | L | A | V | G | H | V | D | E | 3 | 11687 |
| 467 | A | V | G | H | V | D | E | F | L | S | 3 | 11688 |
| 472 | D | H | F | L | S | F | V | P | A | P | 3 | 11689 |
| 473 | E | F | L | S | F | V | P | A | P | D | 3 | 11690 |
| 474 | F | L | S | F | V | P | A | P | D | G | 3 | 11691 |
| 485 | G | F | R | M | L | L | A | S | P | G | 3 | 11692 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 495 | A | C | F | K | L | F | Q | E | K | Q | 3 | 11693 |
| 524 | K | T | I | S | I | N | Q | V | L | S | 3 | 11694 |
| 537 | L | I | N | Y | N | K | F | V | Q | S | 3 | 11695 |
| 547 | C | I | D | W | N | R | E | V | L | K | 3 | 11696 |
| 554 | V | L | K | R | E | L | G | L | A | E | 3 | 11697 |
| 555 | L | K | R | E | L | G | L | A | H | C | 3 | 11698 |
| 562 | A | B | C | D | I | I | D | I | P | Q | 3 | 11699 |
| 565 | D | I | I | D | I | P | Q | L | F | K | 3 | 11700 |
| 567 | I | D | I | P | Q | L | F | K | T | E | 3 | 11701 |
| 576 | E | R | K | K | A | T | A | F | F | P | 3 | 11702 |
| 586 | D | L | V | N | M | L | V | L | G | K | 3 | 11703 |
| 592 | V | L | G | K | H | L | G | I | P | K | 3 | 11704 |
| 613 | L | E | E | K | V | R | S | L | L | E | 3 | 11705 |
| 614 | E | E | K | V | R | S | L | L | B | P | 3 | 11706 |
| 628 | C | T | F | I | D | D | F | T | P | Y | 3 | 11707 |
| 633 | D | F | T | P | Y | H | M | L | H | G | 3 | 11708 |
| 637 | Y | H | M | L | H | G | E | V | H | C | 3 | 11709 |
| 643 | E | V | H | C | G | T | N | V | C | R | 3 | 11710 |
| 644 | V | H | C | G | T | N | V | C | R | K | 3 | 11711 |
| 650 | V | C | R | K | P | F | S | F | K | W | 3 | 11712 |
| 1 | M | S | L | Q | R | I | V | R | V | S | 2 | 11713 |
| 4 | Q | R | I | V | R | V | S | L | B | H | 2 | 11714 |
| 10 | S | L | E | H | P | T | S | A | V | C | 2 | 11715 |
| 15 | T | S | A | V | C | V | A | G | V | E | 2 | 11716 |
| 27 | V | D | I | Y | G | S | V | P | E | G | 2 | 11717 |
| 29 | I | Y | G | S | V | P | E | G | T | E | 2 | 11718 |
| 42 | V | Y | G | T | P | G | V | D | I | Y | 2 | 11719 |
| 44 | G | T | P | G | V | D | I | Y | I | S | 2 | 11720 |
| 52 | I | S | P | N | M | H | R | G | R | E | 2 | 11721 |
| 57 | E | R | G | R | E | P | A | D | T | P | 2 | 11722 |
| 66 | R | R | W | R | F | D | A | T | L | E | 2 | 11723 |
| 75 | H | I | I | V | V | M | N | S | P | S | 2 | 11724 |
| 76 | I | I | V | V | M | N | S | P | S | N | 2 | 11725 |
| 84 | S | N | D | L | N | D | S | H | V | Q | 2 | 11726 |
| 88 | N | D | S | H | V | Q | I | S | Y | H | 2 | 11727 |
| 93 | Q | I | S | Y | H | S | S | H | B | P | 2 | 11728 |
| 102 | P | L | P | L | A | Y | A | V | L | Y | 2 | 11729 |
| 107 | Y | A | V | L | Y | L | T | C | V | D | 2 | 11730 |
| 112 | L | T | C | V | D | I | S | L | D | C | 2 | 11731 |
| 129 | Q | D | R | N | F | V | D | K | R | Q | 2 | 11732 |
| 136 | K | R | Q | W | V | W | G | P | S | G | 2 | 11733 |
| 139 | W | V | W | G | P | S | G | Y | G | G | 2 | 11734 |
| 146 | Y | G | G | I | L | L | V | N | C | D | 2 | 11735 |
| 155 | D | R | D | D | P | S | C | D | V | Q | 2 | 11736 |
| 163 | V | Q | D | N | C | D | Q | H | V | H | 2 | 11737 |
| 164 | Q | D | N | C | D | Q | H | V | H | C | 2 | 11738 |
| 167 | C | D | Q | H | V | H | C | L | Q | D | 2 | 11739 |
| 170 | H | V | H | C | L | Q | D | L | B | D | 2 | 11740 |
| 179 | D | M | S | V | M | V | L | R | T | Q | 2 | 11741 |
| 180 | M | S | V | M | V | L | P | T | Q | G | 2 | 11742 |
| 181 | S | V | M | V | L | P | T | Q | G | P | 2 | 11743 |
| 187 | T | Q | G | P | A | A | L | F | D | D | 2 | 11744 |
| 188 | Q | G | P | A | A | L | F | D | D | H | 2 | 11745 |
| 209 | K | R | A | Q | V | F | H | I | C | G | 2 | 11746 |
| 227 | R | H | V | L | G | Q | D | K | V | S | 2 | 11747 |
| 229 | V | L | G | Q | D | K | V | S | Y | E | 2 | 11748 |
| 248 | R | F | F | V | E | G | L | S | F | P | 2 | 11749 |
| 251 | V | E | G | L | S | F | P | D | A | G | 2 | 11750 |
| 271 | L | D | D | S | N | E | D | F | S | 2 | 11751 |
| 307 | E | V | Y | V | C | R | V | R | N | N | 2 | 11752 |
| 320 | V | D | A | V | A | E | L | A | R | K | 2 | 11753 |
| 333 | K | L | T | I | C | P | Q | A | B | N | 2 | 11754 |
| 344 | N | D | R | W | I | Q | D | E | M | E | 2 | 11755 |
| 347 | W | I | Q | D | E | M | E | L | G | Y | 2 | 11756 |
| 356 | Y | V | Q | A | P | H | K | T | L | P | 2 | 11757 |
| 369 | D | S | P | R | N | G | E | L | Q | D | 2 | 11758 |
| 373 | N | G | E | L | Q | D | F | P | Y | K | 2 | 11759 |
| 377 | Q | D | F | P | Y | K | R | I | L | G | 2 | 11760 |
| 378 | D | F | P | Y | K | R | I | L | G | P | 2 | 11761 |
| 385 | L | G | P | D | F | G | Y | V | T | R | 2 | 11762 |
| 399 | R | S | V | S | G | L | D | S | F | G | 2 | 11763 |
| 430 | I | G | G | N | L | P | G | S | S | G | 2 | 11764 |
| 447 | R | D | F | L | H | A | Q | K | V | Q | 2 | 11765 |
| 448 | D | F | L | H | A | Q | K | V | Q | P | 2 | 11766 |
| 455 | V | Q | P | P | V | E | L | F | V | D | 2 | 11767 |
| 461 | L | F | V | D | W | L | A | V | G | H | 2 | 11768 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 470 | H | V | D | E | F | L | S | F | V | P | 2 | 11769 |
| 484 | K | G | F | R | M | L | L | A | S | P | 2 | 11770 |
| 487 | P | M | L | L | A | S | P | G | A | C | 2 | 11771 |
| 489 | L | L | A | S | P | G | A | C | F | K | 2 | 11772 |
| 513 | L | F | Q | G | V | V | D | D | E | Q | 2 | 11773 |
| 518 | V | D | D | E | Q | V | K | T | I | S | 2 | 11774 |
| 521 | H | Q | V | K | T | I | S | I | N | Q | 2 | 11775 |
| 530 | Q | V | L | S | N | K | D | L | I | N | 2 | 11776 |
| 531 | V | L | S | N | K | D | L | I | N | Y | 2 | 11777 |
| 538 | I | N | Y | N | K | F | V | Q | S | C | 2 | 11778 |
| 544 | V | Q | S | C | I | D | W | N | R | E | 2 | 11779 |
| 585 | P | D | L | V | N | M | L | V | L | G | 2 | 11780 |
| 591 | L | V | L | G | K | H | L | G | I | P | 2 | 11781 |
| 602 | P | F | G | P | I | I | N | G | C | C | 2 | 11782 |
| 607 | I | N | G | C | C | C | L | E | E | K | 2 | 11783 |
| 610 | C | C | C | L | E | E | K | V | R | S | 2 | 11784 |
| 619 | S | L | L | E | P | L | G | L | H | C | 2 | 11785 |
| 623 | P | L | G | L | H | C | T | F | I | D | 2 | 11786 |
| 629 | T | F | I | D | D | F | T | P | Y | H | 2 | 11787 |
| 642 | G | E | V | H | C | G | T | N | V | C | 2 | 11788 |
| 647 | G | T | N | V | C | P | K | P | F | S | 2 | 11789 |
| 649 | N | V | C | R | K | P | F | S | F | K | 2 | 11790 |
| 651 | C | R | K | P | F | S | F | K | W | W | 2 | 11791 |
| 655 | F | S | F | K | W | W | N | H | V | P | 2 | 11792 |
| 5 | R | I | V | R | V | S | L | S | H | P | 1 | 11793 |
| 7 | V | R | V | S | L | E | H | P | T | S | 1 | 11794 |
| 25 | T | L | V | D | I | Y | G | S | V | P | 1 | 11795 |
| 32 | S | V | P | E | G | T | E | M | F | E | 1 | 11796 |
| 37 | T | E | M | F | E | V | Y | G | T | P | 1 | 11797 |
| 40 | F | H | V | Y | G | T | P | G | V | D | 1 | 11798 |
| 46 | P | G | V | D | I | Y | I | S | P | N | 1 | 11799 |
| 50 | I | Y | I | S | P | N | M | E | R | G | 1 | 11800 |
| 55 | N | M | E | R | G | R | E | R | A | D | 1 | 11801 |
| 59 | G | R | E | R | A | D | T | R | R | W | 1 | 11802 |
| 73 | T | L | E | I | I | V | V | M | N | S | 1 | 11803 |
| 77 | I | V | V | M | N | S | P | S | N | D | 1 | 11804 |
| 86 | D | L | N | D | S | H | V | Q | I | S | 1 | 11805 |
| 87 | L | N | D | S | H | V | Q | I | S | Y | 1 | 11806 |
| 95 | S | Y | H | S | S | H | E | P | L | P | 1 | 11807 |
| 109 | V | L | Y | L | T | C | V | D | I | S | 1 | 11808 |
| 117 | I | S | L | D | C | D | L | N | C | S | 1 | 11809 |
| 118 | S | L | D | C | D | L | N | C | E | G | 1 | 11810 |
| 120 | D | C | D | L | N | C | E | G | R | Q | 1 | 11811 |
| 122 | D | L | N | C | S | G | R | Q | D | R | 1 | 11812 |
| 132 | N | F | V | D | K | R | Q | W | V | W | 1 | 11813 |
| 134 | V | D | K | R | Q | W | V | W | G | P | 1 | 11814 |
| 137 | R | Q | W | V | W | G | P | S | G | Y | 1 | 11815 |
| 149 | I | L | L | V | N | C | D | R | D | D | 1 | 11816 |
| 150 | L | L | V | N | C | D | R | D | D | P | 1 | 11817 |
| 151 | L | V | N | C | D | R | D | D | P | S | 1 | 11818 |
| 152 | V | N | C | D | R | D | D | P | S | C | 1 | 11819 |
| 153 | N | C | R | D | D | P | S | C | D | 1 | 11820 |
| 157 | D | D | P | S | C | D | V | Q | D | N | 1 | 11821 |
| 160 | S | C | D | V | Q | D | N | C | D | Q | 1 | 11822 |
| 166 | N | C | D | Q | H | V | H | C | L | Q | 1 | 11823 |
| 195 | D | D | H | K | L | V | L | H | T | S | 1 | 11824 |
| 196 | D | H | K | L | V | L | H | T | S | S | 1 | 11825 |
| 197 | H | K | L | V | L | H | T | S | S | Y | 1 | 11826 |
| 198 | K | L | V | L | H | T | S | S | Y | D | 1 | 11827 |
| 200 | V | L | H | T | S | S | Y | D | A | K | 1 | 11828 |
| 201 | L | H | T | S | S | Y | D | A | K | R | 1 | 11829 |
| 210 | R | A | Q | V | F | H | I | C | G | P | 1 | 11830 |
| 212 | Q | V | F | H | I | C | G | P | H | D | 1 | 11831 |
| 214 | F | H | I | C | G | P | E | D | V | C | 1 | 11832 |
| 217 | C | G | P | E | D | V | C | S | A | Y | 1 | 11833 |
| 219 | P | H | D | V | C | E | A | Y | R | H | 1 | 11834 |
| 224 | S | A | Y | R | H | V | L | G | Q | D | 1 | 11835 |
| 237 | Y | H | V | P | R | L | H | G | D | E | 1 | 11836 |
| 238 | E | V | P | R | L | H | G | D | E | E | 1 | 11837 |
| 249 | F | F | V | S | G | L | S | F | P | D | 1 | 11838 |
| 254 | L | S | F | P | D | A | G | F | T | G | 1 | 11839 |
| 274 | D | S | N | E | D | F | S | A | S | P | 1 | 11840 |
| 291 | F | R | V | A | P | W | I | H | T | P | 1 | 11841 |
| 295 | P | W | I | M | T | P | S | T | L | P | 1 | 11842 |
| 298 | M | T | P | S | T | L | P | P | L | E | 1 | 11843 |
| 300 | P | S | T | L | P | P | L | E | V | Y | 1 | 11844 |

TABLE XLI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 305 | P | L | E | V | Y | V | C | R | V | R | 1 | 11845 |
| 323 | V | A | E | L | A | R | K | A | G | C | 1 | 11846 |
| 332 | C | K | L | T | I | C | P | Q | A | E | 1 | 11847 |
| 335 | T | I | C | P | Q | A | E | N | R | N | 1 | 11848 |
| 336 | I | C | P | Q | A | E | N | R | N | D | 1 | 11849 |
| 338 | P | Q | A | E | N | R | N | D | R | W | 1 | 11850 |
| 346 | R | W | I | Q | D | S | M | E | L | G | 1 | 11851 |
| 349 | Q | D | E | M | E | L | G | Y | V | Q | 1 | 11852 |
| 361 | H | K | T | L | P | V | V | F | D | S | 1 | 11853 |
| 363 | T | L | P | V | V | F | D | S | P | R | 1 | 11854 |
| 366 | V | V | F | D | S | P | R | N | G | E | 1 | 11855 |
| 382 | K | R | I | L | G | P | D | F | G | Y | 1 | 11856 |
| 389 | F | G | Y | V | T | R | E | P | R | D | 1 | 11857 |
| 391 | Y | V | T | R | E | P | R | D | R | S | 1 | 11858 |
| 396 | P | R | D | R | S | V | S | G | L | D | 1 | 11859 |
| 412 | V | S | P | P | V | V | A | N | G | K | 1 | 11860 |
| 415 | P | V | V | A | N | G | K | E | Y | P | 1 | 11861 |
| 424 | P | L | G | R | I | L | I | G | G | N | 1 | 11862 |
| 432 | G | N | L | P | G | S | S | G | R | R | 1 | 11863 |
| 444 | Q | V | V | R | D | F | L | H | A | Q | 1 | 11864 |
| 463 | V | D | W | L | A | V | G | H | V | D | 1 | 11865 |
| 476 | S | F | V | P | A | P | D | G | K | G | 1 | 11866 |
| 493 | P | G | A | C | F | K | L | F | Q | E | 1 | 11867 |
| 494 | G | A | C | F | K | L | F | Q | E | K | 1 | 11868 |
| 498 | K | L | F | Q | E | K | Q | K | C | G | 1 | 11869 |
| 500 | F | Q | E | K | Q | K | C | G | H | G | 1 | 11870 |
| 507 | G | H | G | R | A | L | L | F | Q | G | 1 | 11871 |
| 512 | L | L | F | Q | G | V | V | D | D | E | 1 | 11872 |
| 515 | Q | G | V | V | D | D | E | Q | V | K | 1 | 11873 |
| 526 | I | S | I | N | Q | V | L | S | N | K | 1 | 11874 |
| 532 | L | S | N | K | D | L | I | N | Y | N | 1 | 11875 |
| 536 | D | L | I | N | Y | N | K | F | V | Q | 1 | 11876 |
| 542 | K | F | V | Q | S | C | I | D | W | N | 1 | 11877 |
| 551 | N | R | S | V | L | K | R | E | L | G | 1 | 11878 |
| 556 | K | R | E | L | G | L | A | E | C | D | 1 | 11879 |
| 559 | L | G | L | A | E | C | D | I | I | D | 1 | 11880 |
| 568 | D | I | P | Q | L | F | K | T | E | R | 1 | 11881 |
| 593 | L | G | K | H | L | G | I | P | K | P | 1 | 11882 |
| 596 | H | L | G | I | P | K | P | F | G | P | 1 | 11883 |
| 609 | G | C | C | C | L | E | E | K | V | R | 1 | 11884 |
| 618 | R | S | L | L | E | P | L | G | L | H | 1 | 11885 |
| 624 | L | G | L | H | C | T | F | I | D | D | 1 | 11886 |
| 636 | P | Y | H | M | L | H | G | H | V | H | 1 | 11887 |
| 638 | H | H | L | H | G | H | V | H | C | G | 1 | 11888 |
| 640 | L | H | G | H | V | H | C | G | T | N | 1 | 11889 |
| 645 | H | C | G | T | N | V | C | R | K | P | 1 | 11890 |
| 652 | R | K | P | F | S | F | K | W | W | N | 1 | 11891 |

184P1E2 v.2: HLA Peptide Scoring Results B 0702 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 5 | T | P | S | T | L | A | P | L | E | V | 20 | 11892 |
| 10 | A | P | L | H | V | Y | V | C | R | V | 19 | 11893 |
| 3 | I | M | T | P | S | T | L | A | P | L | 14 | 11894 |
| 7 | S | T | L | A | P | L | H | V | Y | V | 9 | 11895 |
| 1 | P | W | I | M | T | P | S | T | L | A | 7 | 11896 |
| 2 | W | I | M | T | P | S | T | L | A | P | 5 | 11897 |
| 8 | T | L | A | P | L | H | V | Y | V | C | 4 | 11898 |
| 9 | L | A | P | L | H | V | Y | V | C | R | 2 | 11899 |
| 4 | M | T | P | S | T | L | A | P | L | H | 1 | 11900 |
| 6 | P | S | T | L | A | P | L | E | V | Y | 1 | 11901 |

184P1E2 v.3: HLA Peptide Scoring Results B 0702 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 10 | V | P | D | G | K | G | F | R | M | L | 24 | 11902 |
| 8 | V | P | V | P | D | G | K | G | F | R | 12 | 11903 |
| 1 | V | D | H | F | L | S | F | V | P | V | 10 | 11904 |
| 7 | F | V | P | V | P | D | G | K | G | F | 6 | 11905 |
| 9 | P | V | P | D | G | K | G | F | R | M | 6 | 11906 |
| 3 | H | F | L | S | F | V | P | V | P | D | 4 | 11907 |
| 4 | F | L | S | F | V | P | V | P | D | G | 4 | 11908 |
| 2 | D | K | F | L | S | F | V | P | V | P | 3 | 11909 |

TABLE XLII

184P1E2: HLA Peptide Scoring Results B08 10-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XLIII

184P1E2: HLA Peptide Scoring Results B1510 10-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XLIV

184P1E2: HLA Peptide Scoring Results B2705 10-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XLVI

184P1E2: HLA Peptide Scoring Results B2709 10-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XLVI

184P1E2 v.1: HLA Peptide Scoring Results B4402 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 421 | K | E | Y | P | L | G | R | I | L | I | 25 | 11910 |
| 34 | P | E | G | T | E | M | F | E | V | Y | 23 | 11911 |
| 621 | L | H | P | L | G | L | H | C | T | F | 23 | 11912 |
| 245 | D | E | H | P | F | F | V | H | Q | L | 22 | 11913 |
| 276 | N | H | D | F | S | A | S | P | I | F | 22 | 11914 |
| 552 | R | H | V | L | K | R | H | L | G | L | 22 | 11915 |
| 575 | T | H | R | K | K | A | T | A | P | F | 21 | 11916 |
| 557 | R | E | L | G | L | A | H | C | D | I | 20 | 11917 |
| 582 | A | F | F | P | D | L | V | N | M | L | 20 | 11918 |
| 491 | A | S | P | G | A | C | F | K | L | F | 19 | 11919 |
| 192 | A | L | F | D | D | H | K | L | V | L | 18 | 11920 |
| 101 | E | P | L | P | L | A | Y | A | V | L | 17 | 11921 |
| 282 | S | P | I | F | T | D | T | V | V | F | 17 | 11922 |
| 480 | A | P | D | G | K | G | F | P | M | L | 17 | 11923 |
| 546 | S | C | I | D | W | N | R | H | V | L | 17 | 11924 |
| 563 | E | C | D | I | I | D | I | P | Q | L | 17 | 11925 |
| 359 | A | P | H | K | T | L | P | V | V | F | 16 | 11926 |
| 472 | D | I | F | L | S | F | V | P | A | P | 16 | 11927 |
| 651 | C | R | K | P | F | S | F | K | W | W | 16 | 11928 |
| 11 | L | R | H | P | T | S | A | V | C | V | 15 | 11929 |
| 17 | A | V | C | V | A | G | V | E | T | L | 15 | 11930 |
| 98 | S | S | H | E | P | L | P | L | A | Y | 15 | 11931 |
| 100 | H | P | L | P | L | A | Y | A | V | L | 15 | 11932 |
| 102 | P | L | P | L | A | Y | A | V | L | Y | 15 | 11933 |
| 247 | E | P | F | F | V | H | G | L | S | F | 15 | 11934 |
| 263 | G | L | I | S | F | H | V | T | L | L | 15 | 11935 |
| 294 | A | P | W | I | M | T | P | S | T | L | 15 | 11936 |
| 324 | A | H | L | A | R | K | A | G | C | K | 15 | 11937 |

TABLE XLVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 340 | A | E | N | P | N | D | R | W | I | Q | 15 | 11938 |
| 382 | K | R | I | L | G | P | D | F | G | Y | 15 | 11939 |
| 452 | A | Q | K | V | Q | P | P | V | H | L | 15 | 11940 |
| 490 | L | A | S | P | G | A | C | F | K | L | 15 | 11941 |
| 534 | N | K | D | L | I | N | Y | N | K | F | 15 | 11942 |
| 562 | A | H | C | D | I | I | D | I | P | Q | 15 | 11943 |
| 564 | C | D | I | I | D | I | P | Q | L | F | 15 | 11944 |
| 574 | K | T | E | R | K | K | A | T | A | F | 15 | 11945 |
| 597 | L | G | I | P | K | P | F | G | P | I | 15 | 11946 |
| 2 | S | L | Q | R | I | V | R | V | S | L | 14 | 11947 |
| 21 | A | G | V | H | T | L | V | D | I | Y | 14 | 11948 |
| 23 | V | E | T | L | V | D | I | Y | G | S | 14 | 11949 |
| 31 | G | S | V | P | E | G | T | E | M | F | 14 | 11950 |
| 61 | E | R | A | D | T | R | R | W | R | F | 14 | 11951 |
| 74 | L | E | I | I | V | V | H | N | S | P | 14 | 11952 |
| 142 | G | P | S | G | Y | G | G | I | L | L | 14 | 11953 |
| 184 | V | L | R | T | Q | G | P | A | A | L | 14 | 11954 |
| 205 | S | Y | D | A | K | R | A | Q | V | F | 14 | 11955 |
| 251 | V | E | G | L | S | F | P | D | A | G | 14 | 11956 |
| 255 | S | F | P | D | A | G | F | T | G | L | 14 | 11957 |
| 297 | I | M | T | P | S | T | L | P | P | L | 14 | 11958 |
| 325 | E | L | A | R | K | A | G | C | K | L | 14 | 11959 |
| 395 | E | P | R | D | R | S | V | S | Q | L | 14 | 11960 |
| 410 | L | E | V | S | P | P | V | V | A | N | 14 | 11961 |
| 459 | V | E | L | F | V | D | W | L | A | V | 14 | 11962 |
| 503 | K | Q | K | C | G | H | G | R | A | L | 14 | 11963 |
| 505 | K | C | G | H | G | R | A | L | L | F | 14 | 11964 |
| 517 | V | V | D | D | E | Q | V | K | T | I | 14 | 11965 |
| 531 | V | L | S | N | K | D | L | I | N | Y | 14 | 11966 |
| 541 | N | K | F | V | Q | S | C | I | D | W | 14 | 11967 |
| 584 | F | P | D | L | V | N | M | L | V | L | 14 | 11968 |
| 588 | V | N | M | L | V | L | G | K | H | L | 14 | 11969 |
| 594 | G | K | H | L | G | I | P | K | P | F | 14 | 11970 |
| 614 | E | E | K | V | P | S | L | L | H | P | 14 | 11971 |
| 615 | E | K | V | R | S | L | L | H | P | L | 14 | 11972 |
| 617 | V | R | S | L | L | H | P | L | G | L | 14 | 11973 |
| 646 | C | G | T | N | V | C | R | K | P | F | 14 | 11974 |
| 59 | G | R | E | R | A | D | T | R | R | W | 13 | 11975 |
| 78 | V | V | M | N | S | P | S | N | D | L | 13 | 11976 |
| 85 | N | D | L | N | D | S | H | V | Q | I | 13 | 11977 |
| 96 | Y | H | S | S | H | H | P | L | P | L | 13 | 11978 |
| 103 | L | P | L | A | Y | A | V | Y | L | L | 13 | 11979 |
| 108 | A | V | L | Y | L | T | C | V | D | I | 13 | 11980 |
| 110 | L | Y | L | T | C | V | D | I | S | L | 13 | 11981 |
| 124 | N | C | E | G | R | Q | D | R | N | F | 13 | 11982 |
| 125 | C | E | G | R | Q | D | R | N | F | V | 13 | 11983 |
| 132 | N | F | V | D | K | P | Q | W | V | W | 13 | 11984 |
| 165 | D | N | C | D | Q | H | V | H | C | L | 13 | 11985 |
| 176 | D | L | E | D | M | S | V | M | V | L | 13 | 11986 |
| 177 | L | E | D | M | S | V | M | V | L | R | 13 | 11987 |
| 190 | P | A | A | L | F | D | D | H | K | L | 13 | 11988 |
| 217 | C | G | P | E | D | V | C | E | A | Y | 13 | 11989 |
| 221 | D | V | C | E | A | Y | R | H | V | L | 13 | 11990 |
| 228 | H | V | L | G | Q | D | K | V | S | Y | 13 | 11991 |
| 237 | Y | E | V | P | R | L | H | G | D | E | 13 | 11992 |
| 246 | E | H | R | F | F | V | H | G | L | S | 13 | 11993 |
| 252 | E | G | L | S | F | P | D | A | G | F | 13 | 11994 |
| 262 | T | G | L | I | S | F | H | V | T | L | 13 | 11995 |
| 300 | P | S | T | L | P | P | L | E | V | Y | 13 | 11996 |
| 317 | T | C | F | V | D | A | V | A | E | L | 13 | 11997 |
| 327 | A | R | K | A | G | C | K | L | T | I | 13 | 11998 |
| 350 | D | H | M | E | L | G | Y | V | Q | A | 13 | 11999 |
| 355 | G | Y | V | Q | A | P | H | K | T | L | 13 | 12000 |
| 370 | S | P | R | N | G | H | L | Q | D | F | 13 | 12001 |
| 374 | G | E | L | Q | D | F | P | Y | K | P | 13 | 12002 |
| 375 | E | L | Q | D | F | P | Y | K | R | I | 13 | 12003 |
| 394 | P | E | P | R | D | R | S | V | S | G | 13 | 12004 |
| 440 | R | R | V | T | Q | V | V | R | D | F | 13 | 12005 |
| 456 | Q | P | P | V | H | L | F | V | D | W | 13 | 12006 |
| 477 | F | V | P | A | P | D | G | K | Q | F | 13 | 12007 |
| 504 | Q | K | C | G | H | G | R | A | L | L | 13 | 12008 |
| 520 | D | E | Q | V | K | T | I | S | I | N | 13 | 12009 |
| 578 | K | K | A | T | A | F | F | P | D | L | 13 | 12010 |
| 604 | G | P | I | I | N | G | C | C | C | L | 13 | 12011 |
| 611 | C | C | L | E | E | K | V | R | S | L | 13 | 12012 |
| 625 | G | L | H | C | T | F | I | D | D | F | 13 | 12013 |
| 628 | C | T | F | I | D | D | F | T | P | Y | 13 | 12014 |
| 642 | G | E | V | H | C | G | T | N | V | C | 13 | 12015 |
| 37 | T | H | M | F | E | V | Y | G | T | P | 12 | 12016 |
| 40 | F | E | V | Y | G | T | P | G | V | D | 12 | 12017 |
| 41 | E | V | Y | C | T | P | G | V | D | I | 12 | 12018 |
| 42 | V | Y | G | T | P | G | V | D | I | Y | 12 | 12019 |
| 43 | Y | G | V | P | G | V | D | I | Y | I | 12 | 12020 |
| 56 | M | E | R | G | P | E | R | A | D | T | 12 | 12021 |
| 60 | R | E | R | A | D | T | P | R | W | R | 12 | 12022 |
| 68 | W | R | F | D | A | T | L | E | I | I | 12 | 12023 |
| 87 | L | N | D | S | H | V | Q | I | S | Y | 12 | 12024 |
| 130 | D | R | N | F | V | D | K | R | Q | W | 12 | 12025 |
| 185 | L | R | T | Q | G | P | A | A | L | F | 12 | 12026 |
| 197 | H | K | L | V | L | H | T | S | S | Y | 12 | 12027 |
| 219 | P | E | D | V | C | E | A | Y | R | H | 12 | 12028 |
| 223 | C | E | A | Y | R | H | V | L | G | Q | 12 | 12029 |
| 241 | R | L | H | G | D | H | H | R | F | F | 12 | 12030 |
| 258 | D | A | G | F | T | G | L | I | S | F | 12 | 12031 |
| 270 | T | L | L | D | D | S | N | H | D | F | 12 | 12032 |
| 306 | L | E | V | Y | V | C | R | V | R | N | 12 | 12033 |
| 347 | W | I | Q | D | E | M | H | L | G | Y | 12 | 12034 |
| 352 | M | E | L | C | Y | V | Q | A | P | H | 12 | 12035 |
| 376 | L | Q | D | F | P | Y | K | R | I | L | 12 | 12036 |
| 398 | D | R | S | V | S | G | L | D | S | F | 12 | 12037 |
| 401 | V | S | G | L | D | S | F | G | N | L | 12 | 12038 |
| 414 | P | P | V | V | A | N | G | K | H | Y | 12 | 12039 |
| 453 | Q | K | V | Q | P | P | V | E | L | F | 12 | 12040 |
| 468 | V | G | H | V | D | E | F | L | S | F | 12 | 12041 |
| 481 | P | D | G | K | G | F | R | M | L | L | 12 | 12042 |
| 528 | I | N | Q | V | L | S | N | K | D | L | 12 | 12043 |
| 560 | G | L | A | E | C | D | I | I | D | I | 12 | 12044 |
| 612 | C | L | E | E | K | V | R | S | L | L | 12 | 12045 |
| 613 | L | E | E | K | V | R | S | L | L | E | 12 | 12046 |
| 622 | P | L | G | L | H | C | T | F | I | L | 12 | 12047 |
| 631 | I | D | D | F | T | P | Y | H | M | L | 12 | 12048 |
| 65 | T | R | R | W | R | F | D | A | T | L | 11 | 12049 |
| 114 | C | V | D | I | S | L | D | C | D | L | 11 | 12050 |
| 137 | R | Q | W | V | W | G | P | S | Q | Y | 11 | 12051 |
| 140 | V | W | G | P | S | G | Y | G | G | I | 11 | 12052 |
| 141 | W | G | P | S | G | Y | G | G | I | L | 11 | 12053 |
| 168 | D | Q | H | V | H | C | L | Q | D | L | 11 | 12054 |
| 233 | D | K | V | S | Y | E | V | P | R | L | 11 | 12055 |
| 240 | P | R | L | H | G | D | E | E | R | F | 11 | 12056 |
| 256 | F | P | D | A | G | F | T | G | L | I | 11 | 12057 |
| 275 | S | N | E | D | F | S | A | S | P | I | 11 | 12058 |
| 287 | D | T | V | V | F | R | V | A | P | W | 11 | 12059 |
| 367 | V | F | D | S | P | R | N | G | H | L | 11 | 12060 |
| 380 | P | Y | K | R | I | L | G | P | D | F | 11 | 12061 |
| 416 | V | V | A | N | G | K | E | Y | P | L | 11 | 12062 |
| 420 | G | K | R | Y | P | L | G | R | I | L | 11 | 12063 |
| 441 | R | V | T | Q | V | V | R | D | F | L | 11 | 12064 |
| 457 | P | P | V | E | L | F | V | D | W | L | 11 | 12065 |
| 465 | W | L | A | V | G | H | V | D | H | F | 11 | 12066 |
| 466 | L | A | V | G | H | V | D | E | F | L | 11 | 12067 |
| 488 | M | L | L | A | S | P | G | A | C | F | 11 | 12068 |
| 501 | Q | E | K | Q | K | C | G | H | G | R | 11 | 12069 |
| 523 | V | K | T | I | S | I | N | Q | V | L | 11 | 12070 |
| 529 | N | Q | V | L | S | N | K | D | L | I | 11 | 12071 |
| 550 | W | N | R | E | V | L | K | R | H | L | 11 | 12072 |
| 558 | E | L | G | L | A | E | C | D | I | I | 11 | 12073 |
| 648 | T | N | V | C | R | K | P | F | S | F | 11 | 12074 |
| 650 | V | C | R | K | P | F | S | F | K | W | 11 | 12075 |
| 20 | V | A | G | V | E | T | L | V | D | I | 10 | 12076 |
| 67 | R | W | R | F | D | A | T | L | H | I | 10 | 12077 |
| 94 | I | S | Y | H | S | S | H | E | P | L | 10 | 12078 |
| 207 | D | A | K | R | A | Q | V | F | H | I | 10 | 12079 |
| 310 | V | C | R | V | R | N | N | T | C | F | 10 | 12080 |
| 338 | P | Q | A | E | N | R | N | D | R | W | 10 | 12081 |
| 339 | Q | A | N | R | N | D | R | W | I | I | 10 | 12082 |
| 345 | D | R | W | I | Q | D | E | M | E | L | 10 | 12083 |
| 372 | R | N | G | K | E | L | Q | D | F | P | Y | 10 | 12084 |
| 419 | N | G | K | E | Y | P | L | G | R | I | 10 | 12085 |
| 425 | L | G | R | I | L | I | G | G | N | L | 10 | 12086 |
| 519 | D | D | E | Q | V | K | T | I | S | I | 10 | 12087 |
| 567 | I | D | I | P | Q | L | F | K | T | E | 10 | 12088 |
| 590 | M | L | V | L | G | K | H | L | G | I | 10 | 12089 |

TABLE XLVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 259 | A | G | F | T | G | L | I | S | F | H | 9 | 12090 |
| 288 | T | V | V | F | R | V | A | P | W | I | 9 | 12091 |
| 539 | N | Y | N | K | F | V | Q | S | C | I | 9 | 12092 |
| 598 | G | I | P | K | P | F | G | P | I | I | 9 | 12093 |
| 322 | A | V | A | E | L | A | R | K | A | G | 8 | 12094 |
| 377 | Q | D | F | P | Y | K | R | I | L | G | 8 | 12095 |
| 422 | E | Y | P | L | G | R | I | L | I | G | 8 | 12096 |
| 601 | K | P | F | G | P | I | I | N | G | C | 8 | 12097 |
| 191 | A | A | L | F | D | D | H | K | L | V | 7 | 12098 |
| 280 | S | A | S | P | I | F | T | D | T | V | 7 | 12099 |
| 411 | E | V | S | P | P | V | V | A | N | G | 7 | 12100 |
| 12 | R | H | P | T | S | A | V | C | V | A | 6 | 12101 |
| 70 | F | D | A | T | L | E | I | I | V | V | 6 | 12102 |
| 71 | D | A | T | L | E | I | I | V | V | M | 6 | 12103 |
| 72 | A | T | L | E | I | I | V | V | M | N | 6 | 12104 |
| 156 | R | D | D | P | S | C | D | V | Q | D | 6 | 12105 |
| 254 | L | S | F | P | D | A | G | F | T | G | 6 | 12106 |
| 277 | E | D | F | S | A | S | P | I | F | T | 6 | 12107 |
| 301 | S | T | L | P | P | L | E | V | Y | V | 6 | 12108 |
| 302 | T | L | P | P | L | E | V | Y | V | C | 6 | 12109 |
| 330 | A | G | C | K | L | T | I | C | P | Q | 6 | 12110 |
| 351 | E | M | E | L | G | Y | V | Q | A | P | 6 | 12111 |
| 362 | K | T | L | P | V | V | F | D | S | P | 6 | 12112 |
| 412 | V | S | P | P | V | V | A | N | G | K | 6 | 12113 |
| 426 | G | R | I | L | I | G | G | N | L | P | 6 | 12114 |
| 447 | R | D | F | L | H | A | Q | K | V | Q | 6 | 12115 |
| 455 | V | Q | P | P | V | E | L | F | V | D | 6 | 12116 |
| 460 | E | L | F | V | D | W | L | A | V | G | 6 | 12117 |
| 495 | A | C | F | K | L | F | Q | E | K | Q | 6 | 12118 |
| 511 | A | L | L | F | Q | G | V | V | D | D | 6 | 12119 |
| 522 | Q | V | K | T | I | S | I | N | Q | V | 6 | 12120 |
| 524 | K | T | I | S | I | N | Q | V | L | S | 6 | 12121 |
| 571 | Q | L | F | K | T | E | R | K | K | A | 6 | 12122 |
| 44 | G | T | P | G | V | D | I | Y | I | S | 5 | 12123 |
| 48 | V | D | I | Y | I | S | P | N | M | E | 5 | 12124 |
| 51 | Y | I | S | P | N | M | E | R | G | R | 5 | 12125 |
| 55 | N | M | E | R | G | R | H | R | A | D | 5 | 12126 |
| 57 | E | R | G | R | E | R | A | V | T | R | 5 | 12127 |
| 63 | A | D | T | R | R | W | R | F | D | A | 5 | 12128 |
| 75 | E | I | I | V | V | H | N | S | P | S | 5 | 12129 |
| 80 | M | N | S | P | S | N | D | L | N | D | 5 | 12130 |
| 84 | S | N | D | L | N | D | S | H | V | Q | 5 | 12131 |
| 88 | N | D | S | H | V | Q | I | S | Y | H | 5 | 12132 |
| 99 | S | H | E | P | L | P | L | A | Y | A | 5 | 12133 |
| 143 | P | S | G | Y | G | G | I | L | L | V | 5 | 12134 |
| 144 | S | Q | Y | G | G | I | L | L | V | N | 5 | 12135 |
| 178 | E | D | M | S | V | M | V | L | R | T | 5 | 12136 |
| 193 | L | F | D | D | H | K | L | V | L | H | 5 | 12137 |
| 208 | A | K | R | A | Q | V | F | H | I | C | 5 | 12138 |
| 224 | E | A | Y | R | H | V | L | G | Q | D | 5 | 12139 |
| 234 | K | V | S | Y | E | V | P | R | L | H | 5 | 12140 |
| 273 | D | D | S | N | E | D | F | S | A | S | 5 | 12141 |
| 278 | D | F | S | A | S | P | I | F | T | D | 5 | 12142 |
| 281 | A | S | P | I | F | T | D | T | V | V | 5 | 12143 |
| 283 | P | I | F | T | D | T | V | V | F | R | 5 | 12144 |
| 285 | F | T | D | T | V | V | F | R | V | A | 5 | 12145 |
| 131 | N | T | C | F | V | D | A | V | A | E | 5 | 12146 |
| 332 | C | K | L | T | I | C | P | Q | A | E | 5 | 12147 |
| 341 | E | N | R | N | D | R | W | I | Q | D | 5 | 12148 |
| 342 | N | R | N | D | R | W | I | Q | D | E | 5 | 12149 |
| 357 | V | Q | A | P | H | K | T | L | P | V | 5 | 12150 |
| 366 | V | V | F | D | S | P | R | N | G | E | 5 | 12151 |
| 368 | F | D | S | P | R | N | G | E | L | Q | 5 | 12152 |
| 378 | D | F | P | Y | K | R | I | L | G | P | 5 | 12153 |
| 387 | P | D | F | G | Y | V | T | R | E | P | 5 | 12154 |
| 393 | T | R | E | P | R | D | R | S | V | S | 5 | 12155 |
| 402 | S | G | L | D | S | F | G | N | L | E | 5 | 12156 |
| 418 | A | N | G | K | E | Y | P | L | G | R | 5 | 12157 |
| 428 | I | L | I | C | G | N | L | P | G | S | 5 | 12158 |
| 444 | Q | V | V | R | D | F | L | H | A | Q | 5 | 12159 |
| 454 | K | V | Q | P | P | V | E | L | F | V | 5 | 12160 |
| 476 | S | F | V | P | A | P | D | G | K | G | 5 | 12161 |
| 484 | K | G | F | R | M | L | L | A | S | P | 5 | 12162 |
| 487 | R | M | L | L | A | S | P | G | A | C | 5 | 12163 |
| 498 | K | L | F | Q | E | K | Q | K | C | G | 5 | 12164 |
| 526 | I | S | I | N | Q | V | L | S | N | K | 5 | 12165 |
| 536 | D | L | I | N | Y | N | K | F | V | Q | 5 | 12166 |
| 553 | E | V | L | K | R | E | L | C | L | A | 5 | 12167 |
| 565 | D | I | I | D | I | P | Q | L | F | K | 5 | 12168 |
| 572 | L | F | K | T | E | R | K | K | A | T | 5 | 12169 |
| 580 | A | T | A | F | F | P | P | D | L | V | 5 | 12170 |
| 599 | I | P | K | P | F | G | P | I | I | N | 5 | 12171 |
| 600 | P | K | P | F | G | P | I | I | N | C | 5 | 12172 |
| 605 | P | I | I | N | C | C | C | C | L | E | 5 | 12173 |
| 620 | L | L | E | P | L | G | L | H | C | T | 5 | 12174 |
| 629 | T | F | I | D | D | F | T | P | Y | H | 5 | 12175 |
| 1 | M | S | L | Q | R | I | V | R | V | S | 4 | 12176 |
| 4 | Q | R | I | V | R | V | S | L | E | H | 4 | 12177 |
| 9 | V | S | L | E | H | P | T | S | A | V | 4 | 12178 |
| 19 | C | V | A | G | V | E | T | L | V | D | 4 | 12179 |
| 27 | V | D | I | Y | G | S | V | P | E | G | 4 | 12180 |
| 38 | E | M | F | E | V | Y | G | T | P | G | 4 | 12181 |
| 46 | P | G | D | I | Y | I | S | P | N | A | 4 | 12182 |
| 64 | D | T | R | R | W | R | F | D | A | T | 4 | 12183 |
| 81 | N | S | P | S | N | D | L | N | D | S | 4 | 12184 |
| 106 | A | Y | A | V | L | Y | L | T | C | V | 4 | 12185 |
| 111 | Y | L | T | C | V | D | I | S | L | D | 4 | 12186 |
| 115 | V | D | I | S | L | D | C | D | L | N | 4 | 12187 |
| 117 | I | S | L | D | C | D | L | N | C | E | 4 | 12188 |
| 121 | C | D | L | N | C | E | G | R | Q | D | 4 | 12189 |
| 128 | R | Q | D | R | N | F | V | D | K | R | 4 | 12190 |
| 147 | G | G | I | L | L | V | N | C | C | D | 4 | 12191 |
| 153 | N | C | C | D | R | D | D | P | S | C | 4 | 12192 |
| 163 | V | Q | D | N | C | D | Q | H | V | H | 4 | 12193 |
| 179 | D | M | S | V | H | V | L | R | T | Q | 4 | 12194 |
| 183 | M | V | L | R | T | Q | G | P | A | A | 4 | 12195 |
| 187 | T | Q | G | P | A | A | L | F | D | D | 4 | 12196 |
| 202 | H | T | S | S | Y | D | A | K | R | A | 4 | 12197 |
| 203 | T | S | S | Y | D | A | K | R | A | Q | 4 | 12198 |
| 204 | S | S | Y | D | A | K | R | A | Q | V | 4 | 12199 |
| 214 | F | H | I | C | G | P | E | D | V | C | 4 | 12200 |
| 216 | I | C | G | P | E | D | V | C | E | A | 4 | 12201 |
| 227 | R | H | V | L | C | Q | D | K | V | S | 4 | 12202 |
| 238 | E | V | P | R | L | H | G | D | E | E | 4 | 12203 |
| 261 | F | T | G | L | I | S | F | H | V | T | 4 | 12204 |
| 264 | L | I | S | F | H | V | T | L | L | D | 4 | 12205 |
| 265 | I | S | F | H | V | T | L | L | D | D | 4 | 12206 |
| 286 | T | D | T | V | V | F | R | V | A | P | 4 | 12207 |
| 289 | V | V | F | R | V | A | P | W | I | M | 4 | 12208 |
| 291 | F | R | V | A | P | W | I | M | T | P | 4 | 12209 |
| 295 | P | W | I | M | T | P | S | T | L | P | 4 | 12210 |
| 296 | W | I | M | T | P | S | T | L | P | P | 4 | 12211 |
| 299 | T | P | S | T | L | P | P | L | E | V | 4 | 12212 |
| 307 | E | V | Y | V | C | R | V | R | N | N | 4 | 12213 |
| 314 | R | N | N | T | C | F | V | D | A | V | 4 | 12214 |
| 319 | F | V | D | A | V | A | E | L | A | R | 4 | 12215 |
| 334 | L | T | I | C | P | Q | A | E | N | R | 4 | 12216 |
| 335 | T | I | C | P | Q | A | E | N | R | N | 4 | 12217 |
| 346 | R | W | I | Q | D | E | M | E | L | C | 4 | 12218 |
| 369 | D | S | P | R | N | G | E | L | Q | D | 4 | 12219 |
| 384 | I | L | G | P | Q | F | G | Y | V | T | 4 | 12220 |
| 385 | L | G | P | Q | F | G | Y | V | T | R | 4 | 12221 |
| 405 | D | S | F | G | N | L | E | V | S | P | 4 | 12222 |
| 409 | N | L | E | V | S | P | P | V | V | A | 4 | 12223 |
| 423 | Y | P | L | G | R | I | L | I | G | G | 4 | 12224 |
| 424 | P | L | G | R | I | L | I | G | G | N | 4 | 12225 |
| 432 | G | N | L | P | G | S | S | G | R | R | 4 | 12226 |
| 433 | N | L | P | G | S | S | G | R | R | V | 4 | 12227 |
| 435 | P | G | S | S | G | R | R | V | T | Q | 4 | 12228 |
| 436 | G | S | S | G | R | R | V | T | Q | V | 4 | 12229 |
| 437 | S | S | G | R | R | V | T | Q | V | V | 4 | 12230 |
| 438 | S | G | R | R | V | T | Q | V | V | P | 4 | 12231 |
| 467 | A | V | G | H | V | D | E | F | L | S | 4 | 12232 |
| 473 | E | F | L | S | F | V | P | A | P | D | 4 | 12233 |
| 483 | G | K | G | F | R | M | L | L | A | S | 4 | 12234 |
| 496 | C | P | K | L | F | Q | E | K | Q | K | 4 | 12235 |
| 510 | R | A | L | L | F | Q | G | V | V | D | 4 | 12236 |
| 532 | L | S | N | K | D | L | I | N | Y | N | 4 | 12237 |
| 535 | K | D | L | I | N | Y | N | K | F | V | 4 | 12238 |
| 542 | K | F | V | Q | S | C | I | D | W | N | 4 | 12239 |
| 548 | I | D | W | N | R | E | V | L | K | R | 4 | 12240 |
| 549 | D | W | N | R | E | V | L | K | R | E | 4 | 12241 |

TABLE XLVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 554 | V | L | K | R | E | L | G | L | A | E | 4 | 12242 |
| 581 | T | A | F | F | P | D | L | V | N | M | 4 | 12243 |
| 585 | P | D | L | V | N | M | L | V | L | G | 4 | 12244 |
| 589 | N | M | L | V | L | G | K | H | L | G | 4 | 12245 |
| 593 | L | G | K | H | L | G | I | P | K | P | 4 | 12246 |
| 618 | R | S | L | L | E | P | L | G | L | H | 4 | 12247 |
| 632 | D | D | F | T | P | Y | H | M | L | H | 4 | 12248 |
| 633 | D | F | T | P | Y | H | M | L | H | G | 4 | 12249 |
| 8 | R | V | S | L | E | H | P | T | S | A | 3 | 12250 |
| 13 | H | P | T | S | A | V | C | V | A | G | 3 | 12251 |
| 24 | E | T | L | V | D | I | Y | G | S | V | 3 | 12252 |
| 35 | E | G | T | E | M | F | E | V | Y | G | 3 | 12253 |
| 50 | I | Y | I | S | P | N | M | E | R | G | 3 | 12254 |
| 52 | I | S | P | N | M | E | R | G | R | E | 3 | 12255 |
| 62 | R | A | D | T | R | R | W | R | F | D | 3 | 12256 |
| 66 | P | R | W | R | F | D | A | T | L | E | 3 | 12257 |
| 82 | S | P | S | N | D | L | N | D | S | H | 3 | 12258 |
| 92 | V | Q | I | S | Y | H | S | S | H | E | 3 | 12259 |
| 97 | H | S | S | H | E | P | L | P | L | A | 3 | 12260 |
| 107 | Y | A | V | L | Y | L | T | C | V | D | 3 | 12261 |
| 116 | D | I | S | L | D | C | D | L | N | C | 3 | 12262 |
| 126 | E | G | R | Q | D | R | N | F | V | D | 3 | 12263 |
| 127 | G | R | Q | D | P | N | F | V | D | K | 3 | 12264 |
| 129 | Q | D | R | N | F | V | D | K | R | Q | 3 | 12265 |
| 131 | P | N | F | V | D | K | P | Q | W | V | 3 | 12266 |
| 145 | G | Y | G | G | I | L | L | V | N | C | 3 | 12267 |
| 155 | D | R | D | D | P | S | C | D | V | Q | 3 | 12268 |
| 166 | N | C | D | Q | H | V | H | C | L | Q | 3 | 12269 |
| 174 | L | Q | D | L | E | D | M | S | V | M | 3 | 12270 |
| 181 | S | V | M | V | L | R | T | Q | G | P | 3 | 12271 |
| 186 | R | T | Q | G | P | A | A | L | F | D | 3 | 12272 |
| 194 | F | D | D | H | K | L | V | L | H | T | 3 | 12273 |
| 195 | D | D | H | K | L | V | L | H | T | S | 3 | 12274 |
| 200 | V | L | H | T | S | S | Y | D | A | K | 3 | 12275 |
| 210 | R | A | Q | V | F | H | I | C | G | P | 3 | 12276 |
| 211 | A | Q | V | F | H | I | C | G | P | E | 3 | 12277 |
| 220 | E | D | V | C | E | A | Y | R | N | V | 3 | 12278 |
| 225 | A | Y | R | H | V | L | G | Q | D | K | 3 | 12279 |
| 236 | S | Y | E | V | P | R | L | H | G | D | 3 | 12280 |
| 243 | H | G | D | E | E | R | F | F | V | E | 3 | 12281 |
| 248 | R | F | F | V | E | G | L | S | F | P | 3 | 12282 |
| 269 | V | T | L | L | D | D | S | N | E | D | 3 | 12283 |
| 292 | R | V | A | P | W | I | M | T | P | S | 3 | 12284 |
| 298 | M | T | P | S | T | L | P | P | L | E | 3 | 12285 |
| 303 | L | P | P | L | E | V | Y | V | C | R | 3 | 12286 |
| 309 | Y | V | C | P | V | R | N | N | T | C | 3 | 12287 |
| 313 | V | R | N | N | T | C | F | V | D | A | 3 | 12288 |
| 318 | C | F | V | D | A | V | A | E | L | A | 3 | 12289 |
| 321 | D | A | V | A | E | L | A | P | K | A | 3 | 12290 |
| 326 | L | A | R | K | A | G | C | K | L | T | 3 | 12291 |
| 329 | K | A | G | C | K | L | T | I | C | P | 3 | 12292 |
| 353 | E | L | G | Y | V | Q | A | P | H | K | 3 | 12293 |
| 354 | L | G | Y | V | Q | A | P | H | K | T | 3 | 12294 |
| 358 | Q | A | P | H | K | T | L | P | V | V | 3 | 12295 |
| 360 | P | H | K | T | L | P | V | V | F | D | 3 | 12296 |
| 373 | N | G | E | L | Q | D | F | P | Y | K | 3 | 12297 |
| 383 | P | I | L | G | P | D | F | G | Y | V | 3 | 12298 |
| 390 | G | Y | V | T | R | E | P | P | D | R | 3 | 12299 |
| 396 | P | R | D | R | S | V | S | G | L | D | 3 | 12300 |
| 400 | S | V | S | G | L | D | S | F | G | N | 3 | 12301 |
| 404 | L | D | S | F | G | N | L | E | V | S | 3 | 12302 |
| 406 | S | F | G | N | L | E | V | S | P | P | 3 | 12303 |
| 408 | G | N | L | E | V | S | P | P | V | V | 3 | 12304 |
| 413 | S | P | P | V | V | A | N | G | K | E | 3 | 12305 |
| 434 | L | P | G | S | S | G | R | P | V | T | 3 | 12306 |
| 446 | V | R | D | F | L | H | A | Q | K | V | 3 | 12307 |
| 448 | D | F | L | H | A | Q | K | V | Q | P | 3 | 12308 |
| 461 | L | F | V | D | W | L | A | V | G | H | 3 | 12309 |
| 463 | V | D | W | L | A | V | G | H | V | D | 3 | 12310 |
| 475 | L | S | F | V | P | A | P | D | G | K | 3 | 12311 |
| 478 | V | P | A | P | D | G | K | F | G | R | 3 | 12312 |
| 482 | D | G | K | G | F | R | M | L | L | A | 3 | 12313 |
| 506 | C | G | H | C | R | A | L | L | F | Q | 3 | 12314 |
| 507 | G | H | G | R | A | L | L | F | Q | G | 3 | 12315 |
| 512 | L | L | F | Q | G | V | V | D | D | E | 3 | 12316 |
| 516 | G | V | V | D | D | E | Q | V | I | K | 3 | 12317 |
| 521 | E | Q | V | K | T | I | S | I | N | Q | 3 | 12318 |
| 525 | T | I | S | I | N | Q | V | L | S | N | 3 | 12319 |
| 527 | S | I | N | Q | V | L | S | N | K | D | 3 | 12320 |
| 537 | L | I | N | Y | N | K | F | V | Q | S | 3 | 12321 |
| 547 | C | I | D | W | N | R | H | V | L | K | 3 | 12322 |
| 551 | N | R | H | V | L | K | R | H | L | G | 3 | 12323 |
| 556 | K | R | H | L | G | L | A | H | C | D | 3 | 12324 |
| 561 | L | A | H | C | D | I | I | D | I | P | 3 | 12325 |
| 566 | I | I | D | I | P | Q | L | F | K | T | 3 | 12326 |
| 570 | P | Q | L | F | K | T | H | R | K | K | 3 | 12327 |
| 576 | E | R | K | K | A | T | A | F | F | P | 3 | 12328 |
| 579 | K | A | T | A | F | F | P | D | L | V | 3 | 12329 |
| 583 | F | F | P | D | L | V | N | M | L | V | 3 | 12330 |
| 586 | D | L | V | N | H | L | V | L | G | K | 3 | 12331 |
| 591 | L | V | C | K | H | L | C | I | P | 3 | 12332 |
| 595 | K | H | L | C | I | P | K | P | F | C | 3 | 12333 |
| 602 | P | F | C | P | I | I | N | G | C | C | 3 | 12334 |
| 609 | C | C | C | C | L | H | H | K | V | R | 3 | 12335 |
| 619 | S | L | L | H | P | L | G | L | H | C | 3 | 12336 |
| 624 | L | G | L | H | C | T | F | I | D | D | 3 | 12337 |
| 630 | F | I | D | D | F | T | P | Y | H | M | 3 | 12338 |
| 634 | F | T | P | Y | H | M | L | H | G | H | 3 | 12339 |
| 637 | Y | H | M | L | H | G | H | V | H | C | 3 | 12340 |
| 638 | H | M | L | H | G | H | V | H | C | G | 3 | 12341 |
| 643 | H | V | H | C | G | T | N | V | C | R | 3 | 12342 |
| 645 | H | C | G | T | N | V | C | R | K | P | 3 | 12343 |
| 649 | N | V | C | R | K | P | F | S | F | K | 3 | 12344 |
| 653 | K | P | F | S | F | K | W | W | N | M | 3 | 12345 |
| 655 | F | S | F | K | W | W | N | M | V | P | 3 | 12346 |
| 3 | L | Q | R | I | V | R | V | S | L | E | 2 | 12347 |
| 5 | R | I | V | R | V | S | L | H | H | P | 2 | 12348 |
| 10 | S | L | H | H | P | T | S | A | V | C | 2 | 12349 |
| 14 | P | T | S | A | V | C | V | A | G | V | 2 | 12350 |
| 15 | T | S | A | V | C | V | A | G | V | H | 2 | 12351 |
| 16 | S | A | V | C | V | A | G | V | H | T | 2 | 12352 |
| 22 | C | V | E | T | L | V | D | I | Y | G | 2 | 12353 |
| 25 | T | L | V | D | I | Y | G | S | V | P | 2 | 12354 |
| 26 | L | V | D | I | Y | G | S | V | P | E | 2 | 12355 |
| 28 | D | I | Y | G | S | V | P | H | G | T | 2 | 12356 |
| 32 | S | V | P | H | C | T | E | M | F | H | 2 | 12357 |
| 53 | S | P | N | M | E | R | G | R | H | R | 2 | 12358 |
| 54 | P | N | M | H | R | C | R | H | R | A | 2 | 12359 |
| 69 | R | F | D | A | T | L | H | I | I | V | 2 | 12360 |
| 86 | D | L | N | D | S | H | V | Q | I | S | 2 | 12361 |
| 90 | S | H | V | Q | I | S | Y | H | S | S | 2 | 12362 |
| 93 | Q | I | S | Y | H | S | S | H | H | P | 2 | 12363 |
| 95 | S | Y | H | S | S | H | H | P | L | P | 2 | 12364 |
| 104 | P | L | A | Y | A | V | L | Y | L | T | 2 | 12365 |
| 105 | L | A | Y | A | V | L | Y | L | T | C | 2 | 12366 |
| 109 | V | L | Y | L | T | C | V | D | I | S | 2 | 12367 |
| 113 | T | C | V | D | I | S | L | D | C | D | 2 | 12368 |
| 118 | S | L | D | C | D | L | N | C | E | G | 2 | 12369 |
| 120 | D | C | D | L | N | C | H | G | R | Q | 2 | 12370 |
| 133 | F | V | D | K | R | Q | W | V | W | G | 2 | 12371 |
| 134 | V | D | K | R | Q | W | V | W | G | P | 2 | 12372 |
| 146 | Y | G | G | I | L | L | V | N | C | D | 2 | 12373 |
| 148 | G | I | L | L | V | N | C | D | R | D | 2 | 12374 |
| 149 | I | L | L | V | N | C | D | R | D | D | 2 | 12375 |
| 150 | L | L | V | N | C | D | R | D | D | P | 2 | 12376 |
| 157 | D | D | P | S | C | D | V | Q | D | N | 2 | 12377 |
| 159 | P | S | C | D | V | Q | D | N | C | D | 2 | 12378 |
| 160 | S | C | D | V | Q | D | N | C | D | Q | 2 | 12379 |
| 167 | C | D | Q | H | V | H | C | L | Q | D | 2 | 12380 |
| 171 | V | H | C | L | Q | D | L | E | D | H | 2 | 12381 |
| 175 | Q | D | L | H | D | M | S | V | M | V | 2 | 12382 |
| 180 | M | S | V | M | V | L | R | T | Q | C | 2 | 12383 |
| 188 | Q | G | P | A | A | L | F | D | D | H | 2 | 12384 |
| 198 | K | L | V | L | H | T | S | S | Y | D | 2 | 12385 |
| 209 | K | R | A | Q | V | F | H | I | C | G | 2 | 12386 |
| 212 | Q | V | F | H | I | C | G | P | H | D | 2 | 12387 |
| 215 | H | I | C | C | P | H | D | V | C | H | 2 | 12388 |
| 222 | V | C | H | A | Y | R | H | V | L | C | 2 | 12389 |
| 231 | C | Q | D | K | V | S | Y | E | V | P | 2 | 12390 |
| 235 | V | S | Y | H | V | P | R | L | H | G | 2 | 12391 |
| 242 | L | H | C | D | H | H | R | F | F | V | 2 | 12392 |
| 244 | C | D | E | H | R | F | F | V | E | G | 2 | 12393 |

TABLE XLVI-continued

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 250 | F | V | E | G | L | S | F | P | D | A | 2 | 12394 |
| 253 | G | L | S | F | P | D | A | C | F | T | 2 | 12395 |
| 257 | P | D | A | C | F | T | G | L | I | S | 2 | 12396 |
| 266 | S | F | H | V | T | L | L | D | D | S | 2 | 12397 |
| 271 | L | L | D | D | S | N | H | D | F | S | 2 | 12398 |
| 284 | I | F | T | D | T | V | V | F | R | V | 2 | 12399 |
| 293 | V | A | P | W | I | M | T | P | S | T | 2 | 12400 |
| 304 | P | P | L | H | V | Y | Y | V | C | R | V | 2 | 12401 |
| 305 | P | L | E | V | Y | V | C | R | V | R | 2 | 12402 |
| 308 | V | Y | V | C | R | V | R | N | N | T | 2 | 12403 |
| 311 | C | R | V | R | N | N | T | C | F | V | 2 | 12404 |
| 312 | R | V | R | N | N | T | C | F | V | D | 2 | 12405 |
| 315 | N | N | T | C | F | V | D | A | V | A | 2 | 12406 |
| 328 | R | K | A | G | C | K | L | T | I | C | 2 | 12407 |
| 331 | G | C | K | L | T | I | C | P | Q | A | 2 | 12408 |
| 336 | I | C | P | Q | A | E | N | R | N | D | 2 | 12409 |
| 337 | C | P | Q | A | E | N | R | N | D | R | 2 | 12410 |
| 343 | R | N | D | R | W | I | Q | D | E | M | 2 | 12411 |
| 348 | I | Q | D | E | M | E | L | G | Y | V | 2 | 12412 |
| 361 | H | K | T | L | P | V | V | F | D | S | 2 | 12413 |
| 365 | P | V | V | F | D | S | P | R | N | G | 2 | 12414 |
| 386 | G | P | D | F | G | Y | V | T | R | E | 2 | 12415 |
| 391 | Y | V | T | R | E | P | R | D | R | S | 2 | 12416 |
| 403 | G | L | D | S | F | G | N | L | E | V | 2 | 12417 |
| 417 | V | A | N | G | K | E | Y | P | L | G | 2 | 12418 |
| 427 | R | I | L | I | G | G | N | L | P | G | 2 | 12419 |
| 429 | L | I | G | G | N | L | P | G | S | S | 2 | 12420 |
| 439 | G | R | R | V | T | Q | V | V | R | D | 2 | 12421 |
| 443 | T | Q | V | V | R | D | F | L | H | A | 2 | 12422 |
| 445 | V | V | R | D | F | L | H | A | Q | K | 2 | 12423 |
| 451 | H | A | Q | K | V | Q | P | P | V | E | 2 | 12424 |
| 458 | P | V | E | L | F | V | D | W | L | A | 2 | 12425 |
| 462 | F | V | D | W | L | A | V | G | H | V | 2 | 12426 |
| 464 | D | W | L | A | V | G | H | V | D | E | 2 | 12427 |
| 469 | G | H | V | D | E | F | L | S | F | V | 2 | 12428 |
| 470 | H | V | D | E | F | L | S | F | V | P | 2 | 12429 |
| 471 | V | D | E | F | L | S | F | V | P | A | 2 | 12430 |
| 474 | F | L | S | F | V | P | A | P | D | G | 2 | 12431 |
| 479 | P | A | P | D | G | K | G | F | R | M | 2 | 12432 |
| 486 | F | R | M | L | L | A | S | P | G | A | 2 | 12433 |
| 492 | S | P | G | A | C | F | K | L | P | Q | 2 | 12434 |
| 493 | P | G | A | C | F | K | L | F | Q | E | 2 | 12435 |
| 497 | F | K | L | F | Q | E | K | Q | K | C | 2 | 12436 |
| 502 | E | I | Q | K | C | G | H | G | R | A | 2 | 12437 |
| 509 | G | R | A | L | L | F | Q | G | V | V | 2 | 12438 |
| 530 | Q | V | L | S | N | K | D | L | I | N | 2 | 12439 |
| 533 | S | N | K | D | L | I | N | Y | N | K | 2 | 12440 |
| 538 | I | N | Y | N | K | F | V | Q | S | C | 2 | 12441 |
| 544 | V | Q | S | C | I | D | W | N | R | E | 2 | 12442 |
| 559 | L | G | L | A | E | C | D | I | I | D | 2 | 12443 |
| 569 | I | P | Q | L | F | K | T | E | R | K | 2 | 12444 |
| 587 | L | V | N | M | L | V | L | G | K | H | 2 | 12445 |
| 606 | I | I | N | G | C | C | C | L | H | E | 2 | 12446 |
| 608 | N | G | C | C | C | L | E | E | K | V | 2 | 12447 |
| 610 | C | C | C | L | E | E | K | V | R | S | 2 | 12448 |
| 616 | K | V | R | S | L | L | E | P | L | G | 2 | 12449 |
| 623 | P | L | G | L | H | C | T | F | I | D | 2 | 12450 |
| 644 | V | H | C | G | T | N | V | C | R | K | 2 | 12451 |
| 654 | P | F | S | F | K | W | W | N | M | V | 2 | 12452 |
| 6 | I | V | R | V | S | L | E | H | P | T | 1 | 12453 |
| 7 | V | R | V | S | L | E | H | P | T | S | 1 | 12454 |
| 18 | V | C | V | A | G | V | E | T | L | V | 1 | 12455 |
| 29 | I | Y | G | S | V | P | E | G | T | E | 1 | 12456 |
| 30 | Y | G | S | V | P | E | G | T | R | M | 1 | 12457 |
| 33 | V | P | E | G | T | E | M | F | E | V | 1 | 12458 |
| 36 | G | T | E | M | F | E | V | Y | G | T | 1 | 12459 |
| 39 | M | F | E | V | Y | G | T | P | Q | V | 1 | 12460 |
| 45 | T | P | G | V | D | I | Y | I | S | P | 1 | 12461 |
| 47 | G | V | D | I | Y | I | S | P | N | M | 1 | 12462 |
| 73 | T | L | E | I | I | V | V | M | N | S | 1 | 12463 |
| 77 | I | V | V | M | N | S | P | S | N | D | 1 | 12464 |
| 79 | V | M | N | S | P | S | N | D | L | N | 1 | 12465 |
| 83 | P | S | N | D | L | N | D | S | H | V | 1 | 12466 |
| 112 | L | T | C | V | D | I | S | L | D | C | 1 | 12467 |
| 119 | L | D | C | D | L | N | C | E | G | R | 1 | 12468 |
| 122 | D | L | N | C | E | G | R | Q | D | R | 1 | 12469 |
| 136 | K | R | Q | W | V | W | G | P | S | G | 1 | 12470 |
| 139 | W | V | W | G | P | S | G | Y | G | G | 1 | 12471 |
| 152 | V | N | C | D | R | D | D | P | S | C | 1 | 12472 |
| 154 | C | D | R | D | D | P | S | C | D | V | 1 | 12473 |
| 158 | D | P | S | C | D | V | Q | D | N | C | 1 | 12474 |
| 161 | C | D | V | Q | D | N | C | D | Q | H | 1 | 12475 |
| 162 | D | V | Q | D | N | C | D | Q | H | V | 1 | 12476 |
| 164 | Q | D | N | C | D | Q | H | V | B | C | 1 | 12477 |
| 169 | Q | H | V | H | C | L | Q | D | L | E | 1 | 12478 |
| 170 | H | V | H | C | L | Q | D | L | E | D | 1 | 12479 |
| 172 | H | C | L | Q | D | L | E | D | M | S | 1 | 12480 |
| 173 | C | L | Q | D | L | E | D | M | S | V | 1 | 12481 |
| 182 | V | M | V | L | R | T | Q | G | P | A | 1 | 12482 |
| 196 | D | H | K | L | V | L | H | T | S | S | 1 | 12483 |
| 199 | L | V | L | H | T | S | S | Y | D | A | F | 12484 |
| 201 | L | H | T | S | S | Y | D | A | K | R | 1 | 12485 |
| 206 | Y | D | A | K | R | A | Q | V | F | H | 1 | 12486 |
| 213 | V | F | H | I | C | G | P | E | D | V | 1 | 12487 |
| 218 | G | P | E | D | V | C | E | A | Y | R | 1 | 12488 |
| 226 | Y | R | H | V | L | G | Q | D | K | V | 1 | 12489 |
| 229 | V | L | G | Q | D | K | V | S | Y | E | 1 | 12490 |
| 230 | L | Q | Q | D | K | V | S | Y | H | V | 1 | 12491 |
| 232 | Q | D | K | V | S | Y | E | V | P | R | 1 | 12492 |
| 239 | V | P | R | L | H | G | D | E | H | R | 1 | 12493 |
| 260 | G | F | T | G | L | I | S | F | H | V | F | 12494 |
| 267 | F | H | V | T | L | L | D | D | S | N | 1 | 12495 |
| 268 | H | V | T | L | L | D | D | S | N | E | 1 | 12496 |
| 272 | L | D | D | S | N | E | D | F | S | A | 1 | 12497 |
| 279 | F | S | A | S | P | I | F | T | D | T | 1 | 12498 |
| 290 | V | F | R | V | A | P | W | I | M | T | 1 | 12499 |
| 320 | V | D | A | V | A | E | L | A | R | K | 1 | 12500 |
| 323 | V | A | E | L | A | R | K | A | G | C | 1 | 12501 |
| 333 | K | L | T | I | C | P | Q | A | E | N | 1 | 12502 |
| 344 | N | D | R | W | I | Q | D | E | M | E | 1 | 12503 |
| 349 | Q | D | E | M | E | L | G | Y | V | Q | 1 | 12504 |
| 356 | Y | V | Q | A | P | H | K | T | L | P | 1 | 12505 |
| 363 | T | L | P | V | V | F | D | S | P | R | 1 | 12506 |
| 371 | P | R | N | G | E | L | Q | D | F | P | 1 | 12507 |
| 379 | F | P | Y | K | R | I | L | G | P | D | 1 | 12508 |
| 381 | Y | K | R | I | L | G | P | D | F | G | 1 | 12509 |
| 388 | D | F | G | Y | V | T | R | E | P | R | 1 | 12510 |
| 392 | V | T | R | E | P | R | D | R | S | V | 1 | 12511 |
| 397 | R | D | R | S | V | S | G | L | D | S | 1 | 12512 |
| 407 | F | G | N | L | E | V | S | P | P | V | 1 | 12513 |
| 430 | I | G | G | N | L | P | G | S | S | G | 1 | 12514 |
| 431 | G | G | N | L | P | G | S | S | G | R | 1 | 12515 |
| 442 | V | T | Q | V | V | R | D | F | L | H | 1 | 12516 |
| 449 | F | L | H | A | Q | K | V | Q | P | P | 1 | 12517 |
| 485 | G | F | R | M | L | L | A | S | P | G | 1 | 12518 |
| 489 | L | L | A | S | P | G | A | C | F | K | 1 | 12519 |
| 494 | G | A | C | F | K | L | F | Q | E | K | 1 | 12520 |
| 508 | H | G | R | A | L | L | F | Q | G | V | 1 | 12521 |
| 513 | L | F | Q | G | V | V | D | D | E | Q | 1 | 12522 |
| 514 | F | Q | G | V | V | D | D | E | Q | V | 1 | 12523 |
| 515 | Q | G | V | V | D | D | E | Q | V | K | 1 | 12524 |
| 518 | V | D | D | E | Q | V | K | T | I | S | 1 | 12525 |
| 545 | Q | S | C | I | D | W | N | R | E | V | 1 | 12526 |
| 555 | L | K | R | E | L | G | L | A | E | C | 1 | 12527 |
| 568 | D | I | P | Q | L | F | K | T | E | R | 1 | 12528 |
| 573 | F | K | T | E | R | K | K | A | T | A | 1 | 12529 |
| 577 | R | K | K | A | T | A | F | F | P | D | 1 | 12530 |
| 592 | V | L | G | K | H | L | G | I | P | K | 1 | 12531 |
| 596 | H | L | G | I | P | K | P | F | G | P | 1 | 12532 |
| 603 | F | G | P | I | I | N | G | C | C | C | 1 | 12533 |
| 607 | I | N | G | C | C | C | L | E | E | K | 1 | 12534 |
| 626 | L | H | C | T | F | I | D | D | F | T | 1 | 12535 |
| 627 | H | C | T | F | I | D | D | F | T | P | 1 | 12536 |
| 636 | P | Y | H | M | L | H | G | E | V | H | 1 | 12537 |
| 639 | M | L | H | G | E | V | H | C | G | T | 1 | 12538 |
| 640 | L | H | G | E | V | H | C | G | T | N | 1 | 12539 |
| 652 | R | K | P | F | S | F | K | W | W | N | 1 | 12540 |

TABLE XLVI-continued

184P1E2 v.2: HLA Peptide Scoring Results B4402 10-mers SYFPEITHI

| Pos | 1 | 2 | 3 | 4 | 5 | 6 | 7 | 8 | 9 | 0 | score | SEQ. ID NO. |
|---|---|---|---|---|---|---|---|---|---|---|---|---|
| 3 | I | M | T | P | S | T | L | A | P | L | 14 | 12541 |
| 6 | P | S | T | L | A | P | L | E | V | Y | 13 | 12542 |
| 2 | W | I | M | T | P | S | T | L | A | P | 6 | 12543 |
| 8 | T | L | A | P | L | E | V | Y | V | C | 5 | 12544 |
| 10 | A | P | L | E | V | Y | V | C | R | V | 5 | 12545 |
| 1 | P | W | I | M | T | P | S | T | L | A | 4 | 12546 |
| 5 | T | P | S | T | L | A | P | L | E | V | 4 | 12547 |

TABLE XLVII

184P1E2: HLA Peptide Scoring Results B5101 10-mers SYFPEITHI

| Pos | 1 | 2 | 3 | 4 | 5 | 6 | 7 | 8 | 9 | score | SEQ. ID |
|---|---|---|---|---|---|---|---|---|---|---|---|
| NO DATA | | | | | | | | | | | |

TABLE XLVIII

184P1E2 v.1: HLA Peptide Scoring Results DRB1*0101 15-mers SYFPEITHI

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 258 | D | A | G | F | T | G | L | I | S | F | H | V | T | L | L | 33 | 12548 |
| 378 | D | F | P | Y | K | R | I | L | G | P | D | F | G | Y | V | 33 | 12549 |
| 179 | D | M | S | V | M | V | L | R | T | Q | G | P | A | A | L | 32 | 12550 |
| 23 | V | E | T | L | V | D | I | Y | G | S | V | P | E | G | T | 31 | 12551 |
| 182 | V | M | V | L | R | T | Q | G | P | A | A | L | F | D | D | 31 | 12552 |
| 423 | Y | P | L | G | R | I | L | I | G | G | N | L | P | G | S | 29 | 12553 |
| 483 | G | K | G | F | R | M | L | L | A | S | P | G | A | C | F | 29 | 12554 |
| 211 | A | Q | V | F | H | I | C | G | P | E | D | V | C | E | A | 28 | 12555 |
| 287 | D | T | V | V | F | R | V | A | P | W | I | M | T | P | S | 28 | 12556 |
| 37 | T | E | M | F | E | V | Y | G | T | P | G | V | D | I | Y | 27 | 12557 |
| 65 | T | R | R | W | R | F | D | A | T | L | E | I | I | V | V | 27 | 12558 |
| 104 | P | L | A | Y | A | V | L | Y | L | T | C | V | D | I | S | 27 | 12559 |
| 316 | N | T | C | F | V | D | A | V | A | E | L | A | R | K | A | 27 | 12560 |
| 404 | L | D | S | F | G | N | L | E | V | S | P | P | V | V | A | 27 | 12561 |
| 475 | L | S | F | V | P | A | P | D | G | K | G | F | R | M | L | 27 | 12562 |
| 594 | G | K | H | L | G | I | P | K | P | F | G | P | I | I | N | 27 | 12563 |
| 634 | F | T | P | Y | H | M | L | H | G | E | V | H | C | G | T | 27 | 12564 |
| 203 | T | S | S | Y | D | A | K | R | A | Q | V | F | H | I | C | 26 | 12565 |
| 223 | C | E | A | Y | R | H | V | L | G | Q | D | K | V | S | Y | 26 | 12566 |
| 286 | T | D | T | V | V | F | R | V | A | P | W | I | M | T | P | 26 | 12567 |
| 293 | V | A | P | W | I | M | T | P | S | T | L | P | P | L | E | 26 | 12568 |
| 444 | Q | V | V | R | D | F | L | H | A | Q | K | V | Q | P | P | 26 | 12569 |
| 581 | T | A | F | F | P | D | L | V | N | M | L | V | L | G | K | 26 | 12570 |
| 596 | H | L | G | I | P | K | P | F | G | P | I | I | N | G | C | 26 | 12571 |
| 615 | E | K | V | R | S | L | L | E | P | L | G | L | H | C | T | 26 | 12572 |
| 45 | T | P | G | V | D | I | Y | I | S | P | N | M | E | R | G | 25 | 12573 |
| 71 | D | A | T | L | E | I | I | V | V | M | N | S | P | S | N | 25 | 12574 |
| 171 | V | H | C | L | Q | D | L | E | D | M | S | V | M | V | L | 25 | 12575 |
| 323 | V | A | E | L | A | R | K | A | G | C | K | L | T | I | C | 25 | 12576 |
| 431 | G | G | N | L | P | G | S | S | G | R | R | V | T | Q | V | 25 | 12577 |
| 484 | K | G | F | R | M | L | L | A | S | P | G | A | C | F | K | 25 | 12578 |
| 6 | I | V | R | V | S | L | E | H | P | T | S | A | V | C | V | 24 | 12579 |
| 39 | M | F | E | V | Y | G | T | P | G | V | D | I | Y | I | S | 24 | 12580 |
| 106 | A | Y | A | V | L | Y | L | T | C | V | D | I | S | L | D | 24 | 12581 |
| 181 | S | V | M | V | L | R | T | Q | G | P | A | A | L | F | D | 24 | 12582 |
| 236 | S | Y | E | V | P | R | L | H | G | D | E | E | R | F | F | 24 | 12583 |
| 245 | D | E | E | R | F | F | V | E | G | L | S | F | P | D | A | 24 | 12584 |
| 248 | R | F | F | V | E | G | L | S | F | P | D | A | G | F | T | 24 | 12585 |
| 395 | E | P | R | D | R | S | V | S | G | L | D | S | F | G | N | 24 | 12586 |
| 398 | D | R | S | V | S | G | L | D | S | F | G | N | L | E | V | 24 | 12587 |
| 424 | P | L | G | R | I | L | I | G | G | N | L | P | G | S | S | 24 | 12588 |
| 460 | E | L | F | V | D | W | L | A | V | G | H | V | D | E | F | 24 | 12589 |
| 486 | F | R | M | L | L | A | S | P | G | A | C | F | K | L | F | 24 | 12590 |
| 586 | D | L | V | N | M | L | V | L | G | K | H | L | G | I | P | 24 | 12591 |
| 3 | L | Q | R | I | V | R | V | S | L | E | H | P | T | S | A | 23 | 12592 |
| 36 | G | T | E | M | F | E | V | Y | G | T | P | G | V | D | I | 23 | 12593 |
| 292 | R | V | A | P | W | I | M | T | P | S | T | L | P | P | L | 23 | 12594 |
| 439 | G | R | R | V | T | Q | V | V | R | D | F | L | H | A | Q | 23 | 12595 |
| 472 | D | E | F | L | S | F | V | P | A | P | D | G | K | G | F | 23 | 12596 |
| 520 | D | E | Q | V | K | T | I | S | I | N | Q | V | L | S | N | 23 | 12597 |
| 73 | T | L | E | I | I | V | V | M | N | S | P | S | N | D | L | 22 | 12598 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 76 | I | I | V | V | M | N | S | P | S | N | D | L | N | D | S | 22 | 12599 |
| 91 | H | V | Q | I | S | Y | H | S | S | H | E | P | L | P | L | 22 | 12600 |
| 174 | L | Q | D | L | E | D | M | S | V | M | V | L | R | T | Q | 22 | 12601 |
| 197 | H | K | L | V | L | H | T | S | S | Y | D | A | K | R | A | 22 | 12602 |
| 210 | R | A | Q | V | F | H | I | C | G | P | E | D | V | C | E | 22 | 12603 |
| 253 | G | L | S | F | P | D | A | G | F | T | G | L | I | S | F | 22 | 12604 |
| 294 | A | P | W | I | M | T | P | S | T | L | P | P | L | E | V | 22 | 12605 |
| 297 | I | M | T | P | S | T | L | P | P | L | E | V | Y | V | C | 22 | 12606 |
| 351 | E | M | E | L | G | Y | V | Q | A | P | H | K | T | L | P | 22 | 12607 |
| 407 | F | G | N | L | E | V | S | P | P | V | V | A | N | G | K | 22 | 12608 |
| 427 | R | I | L | I | G | G | N | L | P | G | S | S | G | R | R | 22 | 12609 |
| 447 | R | D | F | L | H | A | Q | K | V | Q | P | P | V | E | L | 22 | 12610 |
| 465 | W | L | A | V | G | H | V | D | E | F | L | S | F | V | P | 22 | 12611 |
| 468 | V | G | H | V | D | E | F | L | S | F | V | P | A | P | D | 22 | 12612 |
| 525 | T | I | S | I | N | Q | V | L | S | N | K | D | L | I | N | 22 | 12613 |
| 628 | C | T | F | I | D | D | F | T | P | Y | H | M | L | H | G | 22 | 12614 |
| 17 | A | V | C | V | A | G | V | E | T | L | V | D | I | Y | G | 21 | 12615 |
| 74 | L | E | I | I | V | V | M | N | S | P | S | N | D | L | N | 21 | 12616 |
| 138 | Q | W | V | W | G | P | S | G | Y | G | G | I | L | L | V | 21 | 12617 |
| 450 | L | H | A | Q | K | V | Q | P | P | V | E | L | F | V | D | 21 | 12618 |
| 459 | V | E | L | F | V | D | W | L | A | V | G | H | V | D | E | 21 | 12619 |
| 537 | L | I | N | Y | N | K | F | V | Q | S | C | I | D | W | N | 21 | 12620 |
| 569 | I | P | Q | L | F | K | T | E | R | K | K | A | T | A | F | 21 | 12621 |
| 87 | L | N | D | S | H | V | Q | I | S | Y | H | S | S | H | E | 20 | 12622 |
| 278 | D | F | S | A | S | P | I | F | T | D | T | V | V | F | R | 20 | 12623 |
| 353 | E | L | G | Y | V | Q | A | P | H | K | T | L | P | V | V | 20 | 12624 |
| 376 | L | Q | D | F | P | Y | K | R | I | L | G | P | D | F | G | 20 | 12625 |
| 379 | F | P | Y | K | R | I | L | G | P | D | F | G | Y | V | T | 20 | 12626 |
| 406 | S | F | G | N | L | E | V | S | P | P | V | V | A | N | G | 20 | 12627 |
| 506 | C | G | H | G | R | A | L | L | F | Q | G | V | V | D | D | 20 | 12628 |
| 517 | V | V | D | D | E | Q | V | K | T | I | S | I | N | Q | V | 20 | 12639 |
| 588 | V | N | M | L | V | L | G | K | H | L | G | I | P | K | P | 20 | 12630 |
| 112 | L | T | C | V | D | I | S | L | D | C | D | L | N | C | E | 19 | 12631 |
| 246 | E | E | R | F | F | V | E | G | L | S | F | P | D | A | G | 19 | 12632 |
| 282 | S | P | I | F | T | D | T | V | V | F | R | V | A | P | W | 19 | 12633 |
| 319 | F | V | D | A | V | A | E | L | A | R | K | A | G | C | K | 19 | 12634 |
| 388 | D | F | G | Y | V | T | R | E | P | R | D | R | S | V | S | 19 | 12635 |
| 551 | N | R | E | V | L | K | R | E | L | G | L | A | E | C | D | 19 | 12636 |
| 574 | K | T | E | R | K | K | A | T | A | F | F | P | D | L | V | 19 | 12637 |
| 585 | P | D | L | V | N | M | L | V | L | G | K | H | L | G | I | 19 | 12638 |
| 591 | L | V | L | G | K | H | L | G | I | P | K | P | F | G | P | 19 | 12639 |
| 5 | R | I | V | R | V | S | L | E | H | P | T | S | A | V | C | 18 | 12640 |
| 21 | A | G | V | E | T | L | V | D | I | Y | G | S | V | P | E | 18 | 12641 |
| 24 | E | T | L | V | D | I | Y | G | S | V | P | E | G | T | E | 18 | 12642 |
| 28 | D | I | Y | G | S | V | P | E | G | T | E | M | F | E | V | 18 | 12643 |
| 67 | R | W | R | F | D | A | T | L | E | I | I | V | V | M | N | 18 | 12644 |
| 93 | Q | I | S | Y | H | S | S | H | E | P | L | P | L | A | Y | 18 | 12645 |
| 108 | A | V | L | Y | L | T | C | V | D | I | S | L | D | C | D | 18 | 12646 |
| 137 | R | Q | W | V | W | G | P | S | G | Y | G | G | I | L | L | 18 | 12647 |
| 180 | M | S | V | M | V | L | R | T | Q | G | P | A | A | L | F | 18 | 12648 |
| 193 | L | F | D | D | H | K | L | V | L | H | T | S | S | Y | D | 18 | 12649 |
| 224 | E | A | Y | R | H | V | L | G | G | Q | D | K | V | S | Y | 18 | 12650 |
| 239 | V | P | R | L | H | G | D | E | E | R | F | F | V | E | G | 18 | 12651 |
| 264 | L | I | S | F | H | V | T | L | L | D | D | S | N | E | D | 18 | 12652 |
| 266 | S | F | H | V | T | L | L | D | D | S | N | E | D | F | S | 18 | 12653 |
| 365 | P | V | V | F | D | S | P | R | N | G | E | L | Q | D | F | 18 | 12654 |
| 413 | S | P | P | V | V | A | N | G | K | E | Y | P | L | G | R | 18 | 12655 |
| 426 | G | R | I | L | I | G | G | N | L | P | G | S | S | G | R | 18 | 12656 |
| 446 | V | R | D | F | L | H | A | Q | K | V | Q | P | P | V | E | 18 | 12657 |
| 501 | Q | E | K | Q | K | C | G | H | G | R | A | L | L | F | Q | 18 | 12658 |
| 556 | K | R | E | L | G | L | A | E | C | D | I | I | D | I | P | 18 | 12659 |
| 573 | F | K | T | E | R | K | K | A | T | A | F | F | P | D | L | 18 | 12660 |
| 580 | A | T | A | F | F | P | D | L | V | N | M | L | V | L | G | 18 | 12661 |
| 590 | M | L | V | L | G | K | H | L | G | I | P | K | P | F | G | 18 | 12662 |
| 614 | E | E | K | V | R | S | L | L | E | P | L | G | L | H | C | 18 | 12663 |
| 15 | T | S | A | V | C | V | A | G | V | E | T | L | V | D | I | 17 | 12664 |
| 68 | W | R | F | D | A | T | L | E | I | I | V | V | M | N | S | 17 | 12665 |
| 72 | A | T | L | E | I | I | V | V | M | N | S | P | S | N | D | 17 | 12666 |
| 81 | N | S | P | S | N | D | L | N | D | S | H | V | Q | I | S | 17 | 12667 |
| 84 | S | N | D | L | N | D | S | H | V | Q | I | S | Y | H | S | 17 | 12668 |
| 98 | S | S | H | E | P | L | P | L | A | Y | A | V | L | Y | L | 17 | 12669 |
| 100 | H | E | P | L | P | L | A | Y | A | V | L | Y | L | T | C | 17 | 12670 |
| 107 | Y | A | V | L | Y | L | T | C | V | D | I | S | L | D | C | 17 | 12671 |
| 132 | N | F | V | D | K | R | Q | W | V | W | G | P | S | G | Y | 17 | 12672 |
| 136 | K | R | Q | W | V | W | G | P | S | G | Y | G | G | I | L | 17 | 12673 |
| 140 | V | W | G | P | S | G | Y | G | G | I | L | L | V | N | C | 17 | 12674 |
| 148 | G | I | L | L | V | N | C | D | R | D | D | P | S | C | D | 17 | 12675 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 149 | I | L | L | V | N | C | D | R | D | D | P | S | C | D | V | 17 | 12676 |
| 183 | M | V | L | R | T | Q | G | P | A | A | L | F | D | D | H | 17 | 12677 |
| 194 | F | D | D | H | K | L | V | L | H | T | S | S | Y | D | A | 17 | 12678 |
| 200 | V | L | H | T | S | S | Y | D | A | K | R | A | Q | V | F | 17 | 12679 |
| 247 | E | R | F | F | V | E | G | L | S | F | P | D | A | G | F | 17 | 12680 |
| 251 | V | E | G | L | S | F | P | D | A | G | F | T | G | L | I | 17 | 12681 |
| 261 | F | T | G | L | I | S | F | H | V | T | L | L | D | D | S | 17 | 12682 |
| 290 | V | F | R | V | A | P | W | I | M | T | P | S | T | L | P | 17 | 12683 |
| 295 | P | W | I | M | T | P | S | T | L | P | P | L | E | V | Y | 17 | 12684 |
| 300 | P | S | T | L | P | P | L | E | V | Y | V | C | R | V | R | 17 | 12685 |
| 320 | V | D | A | V | A | E | L | A | R | K | A | G | C | K | L | 17 | 12686 |
| 343 | R | N | D | R | W | I | Q | D | E | M | E | L | G | Y | V | 17 | 12687 |
| 348 | I | Q | D | E | M | E | L | G | Y | V | Q | A | P | H | K | 17 | 12688 |
| 349 | Q | D | E | M | E | L | G | Y | V | Q | A | P | H | K | T | 17 | 12689 |
| 354 | L | G | Y | V | Q | A | P | H | K | T | L | P | V | V | F | 17 | 12690 |
| 363 | T | L | P | V | V | F | D | S | P | R | N | G | E | L | Q | 17 | 12691 |
| 373 | N | G | E | L | Q | D | F | P | Y | K | R | I | L | G | P | 17 | 12692 |
| 389 | F | G | Y | V | T | R | E | P | R | D | R | S | V | S | G | 17 | 12693 |
| 401 | V | S | G | L | D | S | F | G | N | L | E | V | S | P | P | 17 | 12694 |
| 418 | A | N | G | K | E | Y | P | L | G | R | I | L | I | G | G | 17 | 12695 |
| 419 | N | G | K | E | Y | P | L | G | R | I | L | I | G | G | N | 17 | 12696 |
| 455 | V | Q | P | P | V | E | L | F | V | D | W | L | A | V | G | 17 | 12697 |
| 456 | Q | P | P | V | E | L | F | V | D | W | L | A | V | G | H | 17 | 12698 |
| 462 | F | V | D | W | L | A | V | G | H | V | D | E | F | L | S | 17 | 12699 |
| 469 | G | H | V | D | E | F | L | S | F | V | P | A | P | D | G | 17 | 12700 |
| 487 | R | M | L | L | A | S | P | G | A | C | F | K | L | F | Q | 17 | 12701 |
| 507 | G | H | G | R | A | L | L | F | Q | G | V | V | D | D | E | 17 | 12702 |
| 515 | Q | G | V | V | D | D | E | Q | V | K | T | I | S | I | N | 17 | 12703 |
| 526 | I | S | I | N | Q | V | L | S | N | K | D | L | I | N | Y | 17 | 12704 |
| 535 | K | D | L | I | N | Y | N | K | F | V | Q | S | C | I | D | 17 | 12705 |
| 548 | I | D | W | N | R | E | V | L | K | R | E | L | G | L | A | 17 | 12706 |
| 552 | R | E | V | L | K | R | E | L | G | L | A | E | C | D | I | 17 | 12707 |
| 561 | L | A | E | C | D | I | I | D | I | P | Q | L | F | K | T | 17 | 12708 |
| 562 | A | E | C | D | I | I | D | I | P | Q | L | F | K | T | E | 17 | 12709 |
| 566 | I | I | D | I | P | Q | L | F | K | T | E | R | K | K | A | 17 | 12710 |
| 572 | L | F | K | T | E | R | K | K | A | T | A | F | F | P | D | 17 | 12711 |
| 584 | F | P | D | L | V | N | M | L | V | L | G | K | H | L | G | 17 | 12712 |
| 587 | L | V | N | M | L | V | L | G | K | H | L | G | I | P | K | 17 | 12713 |
| 601 | K | P | F | G | P | I | I | N | G | C | C | C | L | E | E | 17 | 12714 |
| 618 | R | S | L | L | E | P | L | G | L | H | C | T | F | I | D | 17 | 12715 |
| 620 | L | L | E | P | L | G | L | H | C | T | F | I | D | D | F | 17 | 12716 |
| 639 | M | L | H | G | E | V | H | C | G | T | N | V | C | R | K | 17 | 12717 |
| 9 | V | S | L | E | H | P | T | S | A | V | C | V | A | G | V | 16 | 12718 |
| 12 | E | H | P | T | S | A | V | C | V | A | G | V | E | T | L | 16 | 12719 |
| 20 | V | A | G | V | E | T | L | V | D | I | Y | G | S | V | P | 16 | 12720 |
| 26 | L | V | D | I | Y | G | S | V | P | E | G | T | E | M | F | 16 | 12721 |
| 27 | V | D | I | Y | G | S | V | P | E | G | T | E | M | F | E | 16 | 12722 |
| 29 | I | Y | G | S | V | P | E | G | T | E | M | F | E | V | Y | 16 | 12723 |
| 75 | E | I | I | V | V | M | N | S | P | S | N | D | L | N | D | 16 | 12724 |
| 97 | H | S | S | H | E | P | L | P | L | A | Y | A | V | L | Y | 16 | 12725 |
| 99 | S | H | E | P | L | P | L | A | Y | A | V | L | Y | L | T | 16 | 12726 |
| 139 | W | V | W | G | P | S | G | Y | G | G | I | T | L | V | N | 16 | 12727 |
| 143 | P | S | G | Y | G | G | I | L | L | V | N | C | D | R | D | 16 | 12728 |
| 152 | V | N | C | D | R | D | D | P | S | C | D | V | Q | D | N | 16 | 12729 |
| 160 | S | C | D | V | Q | D | N | C | D | Q | H | V | H | C | L | 16 | 12730 |
| 168 | D | Q | H | V | H | C | L | Q | D | L | E | D | M | S | V | 16 | 12731 |
| 190 | P | A | A | L | F | D | D | H | K | L | V | L | H | T | S | 16 | 12732 |
| 196 | D | H | K | L | V | L | H | T | S | S | Y | D | A | K | R | 16 | 12733 |
| 219 | P | E | D | V | C | E | A | Y | R | H | V | L | G | Q | D | 16 | 12734 |
| 229 | V | L | G | Q | D | K | V | S | Y | E | V | P | R | L | H | 16 | 12735 |
| 255 | S | F | P | D | A | G | F | T | G | L | I | S | F | H | V | 16 | 12736 |
| 268 | H | V | T | L | L | D | D | S | N | E | D | F | S | A | S | 16 | 12737 |
| 269 | V | T | L | L | D | D | S | N | E | D | F | S | A | S | P | 16 | 12738 |
| 273 | D | D | S | N | E | D | F | S | A | S | P | I | F | T | D | 16 | 12739 |
| 357 | V | Q | A | P | H | K | T | L | P | V | V | F | D | S | P | 16 | 12740 |
| 381 | Y | K | R | I | L | G | P | D | F | G | Y | V | T | R | E | 16 | 12741 |
| 382 | K | R | I | L | G | P | D | F | G | Y | V | T | R | E | P | 16 | 12742 |
| 386 | G | P | D | F | G | Y | V | T | R | E | P | R | D | R | S | 16 | 12743 |
| 405 | D | S | F | G | N | L | E | V | S | P | P | V | V | A | N | 16 | 12744 |
| 410 | L | E | V | S | P | P | V | V | A | N | G | K | E | Y | P | 16 | 12745 |
| 414 | P | P | V | V | A | N | G | K | E | Y | P | L | G | R | I | 16 | 12746 |
| 422 | E | Y | P | L | G | R | I | L | I | G | G | N | L | P | G | 16 | 12747 |
| 428 | I | L | I | G | G | N | L | P | G | S | S | G | R | R | V | 16 | 12748 |
| 438 | S | G | R | R | V | T | Q | V | V | R | D | F | L | H | A | 16 | 12749 |
| 452 | A | Q | K | V | Q | P | P | V | E | L | F | V | D | W | L | 16 | 12750 |
| 463 | V | D | W | L | A | V | G | H | V | D | E | F | L | S | F | 16 | 12751 |
| 471 | V | D | E | F | L | S | F | V | P | A | P | D | G | K | G | 16 | 12752 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 477 | F | V | P | A | P | D | G | K | G | F | R | M | L | L | A | 16 | 12753 |
| 503 | K | Q | K | C | G | H | G | R | A | L | L | F | Q | G | V | 16 | 12754 |
| 509 | G | R | A | L | L | F | Q | G | V | V | D | D | E | Q | V | 16 | 12755 |
| 511 | A | L | L | F | Q | G | V | V | D | D | E | Q | V | K | T | 16 | 12756 |
| 532 | L | S | N | K | D | L | I | N | Y | N | K | F | V | Q | S | 16 | 12757 |
| 555 | L | K | R | E | L | G | L | A | E | C | D | I | I | D | I | 16 | 12758 |
| 558 | E | L | G | L | A | E | C | D | I | I | D | I | P | Q | L | 16 | 12759 |
| 589 | N | M | L | V | L | G | K | H | L | G | I | P | K | P | F | 16 | 12760 |
| 592 | V | L | G | K | H | L | G | I | P | K | P | F | G | P | I | 16 | 12761 |
| 600 | P | K | P | F | G | P | I | I | N | G | C | C | C | L | E | 16 | 12762 |
| 610 | C | C | C | L | E | E | K | V | R | S | L | L | E | P | L | 16 | 12763 |
| 617 | V | R | S | L | L | E | P | L | G | L | H | C | T | F | I | 16 | 12764 |
| 623 | P | L | G | L | H | C | T | F | I | D | D | F | T | P | Y | 16 | 12765 |
| 625 | G | L | H | C | T | F | I | D | D | F | T | P | Y | H | M | 16 | 12766 |
| 627 | H | C | T | F | I | D | D | F | T | P | Y | H | M | L | H | 16 | 12767 |
| 644 | V | H | C | G | T | N | V | C | R | K | P | F | S | F | K | 16 | 12768 |
| 14 | P | T | S | A | V | C | V | A | G | V | E | T | L | V | D | 15 | 12769 |
| 88 | N | D | S | H | V | Q | I | S | Y | H | S | S | H | E | P | 15 | 12770 |
| 94 | I | S | Y | H | S | S | H | E | P | L | P | L | A | Y | A | 15 | 12771 |
| 109 | V | L | Y | L | T | C | V | D | I | S | L | D | C | D | L | 15 | 12772 |
| 146 | Y | G | G | I | L | L | V | N | C | D | R | D | D | P | S | 15 | 12773 |
| 169 | Q | H | V | H | C | L | Q | D | L | E | D | M | S | V | M | 15 | 12774 |
| 177 | L | E | D | M | S | V | M | V | L | R | T | Q | G | P | A | 15 | 12775 |
| 232 | Q | D | K | V | S | Y | E | V | P | R | L | H | G | D | E | 15 | 12776 |
| 262 | T | G | L | I | S | F | H | V | T | L | L | D | D | S | N | 15 | 12777 |
| 272 | L | D | D | S | N | E | D | F | S | A | S | P | I | F | T | 15 | 12778 |
| 274 | D | S | N | E | D | F | S | A | S | P | I | F | T | D | T | 15 | 12779 |
| 280 | S | A | S | P | I | F | T | D | T | V | V | F | R | V | A | 15 | 12780 |
| 283 | P | I | F | T | D | T | V | V | F | R | V | A | P | W | I | 15 | 12781 |
| 284 | I | F | T | D | T | V | V | F | R | V | A | P | W | I | M | 15 | 12782 |
| 309 | Y | V | C | R | V | R | N | N | T | C | F | V | D | A | V | 15 | 12783 |
| 314 | R | N | N | T | C | F | V | D | A | V | A | E | L | A | R | 15 | 12784 |
| 346 | R | W | I | Q | D | E | M | E | L | G | Y | V | Q | A | P | 15 | 12785 |
| 385 | L | G | P | D | F | G | Y | V | T | R | E | P | R | D | R | 15 | 12786 |
| 457 | P | P | V | E | L | F | V | D | W | L | A | V | G | H | V | 15 | 12787 |
| 485 | G | F | R | M | L | L | A | S | P | G | A | C | F | K | L | 15 | 12788 |
| 516 | G | V | V | D | D | E | Q | V | K | T | I | S | I | N | Q | 15 | 12789 |
| 577 | R | K | K | A | T | A | F | F | P | D | L | V | N | M | L | 15 | 12790 |
| 582 | A | F | F | P | D | L | V | N | M | L | V | L | G | K | H | 15 | 12791 |
| 621 | L | E | P | L | G | L | H | C | T | F | I | D | D | F | T | 15 | 12792 |
| 646 | C | G | T | N | V | C | R | K | P | F | S | F | K | W | W | 15 | 12793 |
| 7 | V | R | V | S | L | E | H | P | T | S | A | V | C | V | A | 14 | 12794 |
| 8 | R | V | S | L | E | H | P | T | S | A | V | C | V | A | G | 14 | 12795 |
| 42 | V | Y | G | T | P | G | V | D | I | Y | I | S | P | N | M | 14 | 12796 |
| 123 | L | N | C | E | G | R | Q | D | R | N | F | V | D | K | R | 14 | 12797 |
| 134 | V | D | K | R | Q | W | V | W | G | P | S | G | Y | G | G | 14 | 12798 |
| 163 | V | Q | D | N | C | D | Q | H | V | H | C | L | Q | D | L | 14 | 12799 |
| 173 | C | L | Q | D | L | E | D | M | S | V | M | V | L | R | T | 14 | 12800 |
| 195 | D | D | H | K | L | V | L | H | T | S | S | Y | D | A | K | 14 | 12801 |
| 226 | Y | R | H | V | L | G | Q | D | K | V | S | Y | E | V | P | 14 | 12802 |
| 228 | H | V | L | G | Q | D | K | V | S | Y | E | V | P | R | L | 14 | 12803 |
| 254 | L | S | F | P | D | A | G | F | T | G | L | I | S | F | H | 14 | 12804 |
| 302 | T | L | P | P | L | E | V | Y | V | C | R | V | R | N | N | 14 | 12805 |
| 307 | E | V | Y | V | C | R | V | R | N | N | T | C | F | V | D | 14 | 12806 |
| 317 | T | C | F | V | D | A | V | A | E | L | A | R | K | A | G | 14 | 12807 |
| 327 | A | R | K | A | G | C | K | L | T | I | C | P | Q | A | E | 14 | 12808 |
| 333 | K | L | T | I | C | P | Q | A | E | N | R | N | D | R | W | 14 | 12809 |
| 355 | G | Y | V | Q | A | P | H | K | T | L | P | V | V | F | D | 14 | 12810 |
| 360 | P | H | K | T | L | P | V | V | F | D | S | P | R | N | G | 14 | 12811 |
| 361 | H | K | T | L | P | V | V | F | D | S | P | R | N | G | E | 14 | 12812 |
| 435 | P | G | S | S | G | R | R | V | T | Q | V | V | R | D | F | 14 | 12813 |
| 449 | F | L | H | A | Q | K | V | Q | P | P | V | E | L | F | V | 14 | 12814 |
| 482 | D | G | K | G | F | R | M | L | L | A | S | P | G | A | C | 14 | 12815 |
| 512 | L | L | F | Q | G | V | V | D | D | E | Q | V | K | T | I | 14 | 12816 |
| 522 | Q | V | K | T | I | S | I | N | Q | V | L | S | N | K | D | 14 | 12817 |
| 538 | I | N | Y | N | K | F | V | Q | S | C | I | D | W | N | R | 14 | 12818 |
| 563 | E | C | D | I | I | D | I | P | Q | L | F | K | T | E | R | 14 | 12819 |
| 611 | C | C | L | E | E | K | V | R | S | L | L | E | P | L | G | 14 | 12820 |
| 633 | D | F | T | P | Y | H | M | L | H | G | E | V | H | C | G | 14 | 12821 |
| 352 | M | E | L | G | Y | V | Q | A | P | H | K | T | L | P | V | 13 | 12822 |
| 494 | G | A | C | F | K | L | F | Q | E | K | Q | K | C | G | H | 13 | 12823 |
| 46 | P | G | V | D | I | Y | I | S | P | N | M | E | R | G | R | 12 | 12824 |
| 234 | K | V | S | Y | E | V | P | R | L | H | G | D | E | E | R | 12 | 12825 |
| 279 | F | S | A | S | P | I | F | T | D | T | V | V | F | R | V | 12 | 12826 |
| 288 | T | V | V | F | R | V | A | P | W | I | M | T | P | S | T | 12 | 12827 |
| 291 | F | R | V | A | P | W | I | M | T | P | S | T | L | P | P | 12 | 12828 |
| 330 | A | G | C | K | L | T | I | C | P | Q | A | E | N | R | N | 12 | 12829 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 331 | G | C | K | L | T | I | C | P | Q | A | E | N | R | N | D | 12 | 12830 |
| 393 | T | R | E | P | R | D | R | S | V | S | G | L | D | S | F | 12 | 12831 |
| 425 | L | G | R | I | L | I | G | G | N | L | P | G | S | S | G | 12 | 12832 |
| 474 | F | L | S | F | V | P | A | P | D | G | K | G | F | R | M | 12 | 12833 |
| 497 | F | K | L | F | Q | E | K | Q | K | C | G | H | G | R | A | 12 | 12834 |
| 521 | E | Q | V | K | T | I | S | I | N | Q | V | L | S | N | K | 12 | 12835 |
| 533 | S | N | K | D | L | I | N | Y | N | K | F | V | Q | S | C | 12 | 12836 |
| 543 | F | V | Q | S | C | I | D | W | N | R | E | V | L | K | R | 12 | 12837 |
| 547 | C | I | D | W | N | R | E | V | L | K | R | E | L | G | L | 12 | 12838 |
| 550 | W | N | R | E | V | L | K | R | E | L | G | L | A | E | C | 12 | 12839 |
| 564 | C | D | I | I | D | I | P | Q | L | F | K | T | E | R | K | 12 | 12840 |
| 570 | P | Q | L | F | K | T | E | R | K | K | A | T | A | F | F | 12 | 12841 |
| 602 | P | F | G | P | I | I | N | G | C | C | C | L | E | E | K | 12 | 12842 |
| 1 | M | S | L | Q | R | I | V | R | V | S | L | E | H | P | T | 11 | 12843 |
| 40 | F | E | V | Y | G | T | P | G | V | D | I | Y | I | S | P | 11 | 12844 |
| 47 | G | V | D | I | Y | I | S | P | N | M | E | R | G | R | E | 11 | 12845 |
| 49 | D | I | Y | I | S | P | N | M | E | R | G | R | E | R | A | 11 | 12846 |
| 51 | Y | I | S | P | N | M | E | R | G | R | E | R | A | D | T | 11 | 12847 |
| 89 | D | S | H | V | Q | I | S | Y | H | S | S | H | E | P | L | 11 | 12848 |
| 130 | D | R | N | F | V | D | K | R | Q | W | V | W | G | P | S | 11 | 12849 |
| 144 | S | G | Y | G | I | L | L | V | N | C | D | R | D | D | | 11 | 12850 |
| 225 | A | Y | R | H | V | L | G | Q | D | K | V | S | Y | E | V | 11 | 12851 |
| 244 | G | D | E | E | R | F | F | V | E | G | L | S | F | P | D | 11 | 12852 |
| 260 | G | F | T | G | L | I | S | F | H | V | T | L | L | D | D | 11 | 12853 |
| 306 | L | E | V | Y | V | C | R | V | R | N | N | T | C | F | V | 11 | 12854 |
| 308 | V | Y | V | C | R | V | R | N | N | T | C | F | V | D | A | 11 | 12855 |
| 344 | N | D | R | W | I | Q | D | E | M | E | L | G | Y | V | Q | 11 | 12856 |
| 368 | F | D | S | P | R | N | G | E | L | Q | D | F | P | Y | K | 11 | 12857 |
| 390 | G | Y | V | T | R | E | P | R | D | R | S | V | S | G | L | 11 | 12858 |
| 420 | G | K | E | Y | P | L | G | R | I | L | I | G | G | N | L | 11 | 12859 |
| 429 | L | I | G | G | N | L | P | G | S | S | G | R | R | V | T | 11 | 12860 |
| 493 | P | G | A | C | F | K | L | F | Q | E | K | Q | K | C | G | 11 | 12861 |
| 499 | L | F | Q | E | K | Q | K | C | G | H | G | R | A | L | L | 11 | 12862 |
| 500 | F | Q | E | K | Q | K | C | G | H | G | R | A | L | L | F | 11 | 12863 |
| 514 | F | Q | G | V | V | D | D | E | Q | V | K | T | I | S | I | 11 | 12864 |
| 523 | V | K | T | I | S | I | N | Q | V | L | S | N | K | D | L | 11 | 12865 |
| 540 | Y | N | K | F | V | Q | S | C | I | D | W | N | R | E | V | 11 | 12866 |
| 553 | E | V | L | K | R | E | L | G | L | A | E | C | D | I | I | 11 | 12867 |
| 631 | I | D | D | F | T | P | Y | H | M | L | H | G | E | V | H | 11 | 12868 |
| 648 | T | N | V | C | R | K | P | F | S | F | K | W | W | N | M | 11 | 12869 |
| 4 | Q | R | I | V | R | V | S | L | E | H | P | T | S | A | V | 10 | 12870 |
| 16 | S | A | V | C | V | A | G | V | E | T | L | V | D | I | Y | 10 | 12871 |
| 48 | V | D | I | Y | I | S | P | N | M | E | R | G | R | E | R | 10 | 12872 |
| 63 | A | D | T | R | R | W | R | F | D | A | T | L | E | I | I | 10 | 12873 |
| 69 | R | F | D | A | T | L | E | I | I | V | V | M | N | S | P | 10 | 12874 |
| 117 | I | S | L | D | C | D | L | N | C | E | G | R | Q | D | R | 10 | 12875 |
| 119 | L | D | C | D | L | N | C | E | G | R | Q | D | R | N | F | 10 | 12876 |
| 120 | D | C | D | L | N | C | E | G | R | Q | D | R | N | F | V | 10 | 12877 |
| 131 | R | N | F | V | D | K | R | Q | W | V | W | G | P | S | G | 10 | 12878 |
| 133 | F | V | D | K | R | Q | W | V | W | G | P | S | G | Y | G | 10 | 12879 |
| 188 | Q | G | P | A | A | L | F | D | D | H | K | L | V | L | H | 10 | 12880 |
| 189 | G | P | A | A | L | F | D | D | H | K | L | V | L | H | T | 10 | 12881 |
| 191 | A | A | L | F | D | D | H | K | L | V | L | H | T | S | S | 10 | 12882 |
| 208 | A | K | R | A | Q | V | F | H | I | C | G | P | E | D | V | 10 | 12883 |
| 218 | G | P | E | D | V | C | E | A | Y | R | H | V | L | G | Q | 10 | 12884 |
| 231 | G | Q | D | K | V | S | Y | E | V | P | R | L | H | G | D | 10 | 12885 |
| 243 | H | G | D | E | E | R | F | F | V | E | G | L | S | F | P | 10 | 12886 |
| 250 | F | V | E | G | L | S | F | P | D | A | G | F | T | G | L | 10 | 12887 |
| 256 | F | P | D | A | G | F | T | G | L | I | S | F | H | V | T | 10 | 12888 |
| 276 | N | E | D | F | S | A | S | P | I | F | T | D | T | V | V | 10 | 12889 |
| 310 | V | C | R | V | R | N | N | T | C | F | V | D | A | V | A | 10 | 12890 |
| 328 | R | K | A | G | C | K | L | T | I | C | P | Q | A | E | N | 10 | 12891 |
| 329 | K | A | G | C | K | L | T | I | C | P | Q | A | E | N | R | 10 | 12892 |
| 345 | D | R | W | I | Q | D | E | M | E | L | G | Y | V | Q | A | 10 | 12893 |
| 359 | A | P | H | K | T | L | P | V | V | F | D | S | P | R | N | 10 | 12894 |
| 364 | L | P | V | V | F | D | S | P | R | N | G | E | L | Q | D | 10 | 12895 |
| 374 | G | E | L | Q | D | F | P | Y | K | R | I | L | G | P | D | 10 | 12896 |
| 412 | V | S | P | P | V | V | A | N | G | K | E | Y | P | L | G | 10 | 12897 |
| 416 | V | V | A | N | G | K | E | Y | P | L | G | R | I | L | I | 10 | 12898 |
| 443 | T | Q | V | V | R | D | F | L | H | A | Q | K | V | Q | P | 10 | 12899 |
| 478 | V | P | A | P | D | G | K | G | F | R | M | L | L | A | S | 10 | 12900 |
| 479 | P | A | P | D | G | K | G | F | R | M | L | L | A | S | P | 10 | 12901 |
| 527 | S | I | N | Q | V | L | S | N | K | D | L | I | N | Y | N | 10 | 12902 |
| 607 | I | N | G | C | C | C | L | E | E | K | V | R | S | L | L | 10 | 12903 |
| 608 | N | G | C | C | C | L | E | E | K | V | R | S | L | L | E | 10 | 12904 |
| 637 | Y | H | M | L | H | G | E | V | H | C | G | T | N | V | C | 10 | 12905 |
| 643 | E | V | H | C | G | T | N | V | C | R | K | P | F | S | F | 10 | 12906 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 31 | G | S | V | P | E | G | T | E | M | F | E | V | Y | G | T | 9 | 12907 |
| 35 | E | G | T | E | M | F | E | V | Y | G | T | P | G | V | D | 9 | 12908 |
| 41 | E | V | Y | G | T | P | G | V | D | I | Y | I | S | P | N | 9 | 12909 |
| 52 | I | S | P | N | M | E | R | G | R | E | R | A | D | T | R | 9 | 12910 |
| 53 | S | P | N | M | E | R | G | R | E | R | A | D | T | R | R | 9 | 12911 |
| 61 | E | R | A | D | T | R | R | W | R | F | D | A | T | L | E | 9 | 12912 |
| 64 | D | T | R | R | W | R | F | D | A | T | L | E | I | I | V | 9 | 12913 |
| 77 | I | V | V | M | N | S | P | S | N | D | L | N | D | S | H | 9 | 12914 |
| 114 | C | V | D | I | S | L | D | C | D | L | N | C | E | G | R | 9 | 12915 |
| 122 | D | L | N | C | E | G | R | Q | D | R | N | F | V | D | K | 9 | 12916 |
| 128 | R | Q | D | R | N | F | V | D | K | R | Q | W | V | W | G | 9 | 12917 |
| 135 | D | K | R | Q | W | V | W | G | P | S | G | Y | G | G | I | 9 | 12918 |
| 141 | W | G | P | S | G | Y | G | G | I | L | L | V | N | C | D | 9 | 12919 |
| 145 | G | Y | G | G | I | L | L | V | N | C | D | R | D | D | P | 9 | 12920 |
| 147 | G | G | I | L | L | V | N | C | D | R | D | D | P | S | C | 9 | 12921 |
| 172 | H | C | L | Q | D | L | E | D | M | S | V | M | V | L | R | 9 | 12922 |
| 178 | E | D | M | S | V | M | V | L | R | T | Q | G | P | A | A | 9 | 12923 |
| 205 | S | Y | D | A | K | R | A | Q | V | F | H | I | C | G | P | 9 | 12924 |
| 213 | V | F | H | I | C | G | P | E | D | V | C | E | A | Y | R | 9 | 12925 |
| 217 | C | G | P | E | D | V | C | E | A | Y | R | H | V | L | G | 9 | 12926 |
| 240 | P | R | L | H | G | D | E | E | R | F | F | V | E | G | L | 9 | 12927 |
| 265 | I | S | F | H | V | T | L | L | D | D | S | N | E | D | F | 9 | 12928 |
| 270 | T | L | L | D | D | S | N | E | D | F | S | A | S | P | I | 9 | 12929 |
| 289 | V | V | F | R | V | A | P | W | I | M | T | P | S | T | L | 9 | 12930 |
| 303 | L | P | P | L | E | V | Y | V | C | R | V | R | N | N | T | 9 | 12931 |
| 305 | P | L | E | V | Y | V | C | R | V | R | N | N | T | C | F | 9 | 12932 |
| 311 | C | R | V | R | N | N | T | C | F | V | D | A | V | A | E | 9 | 12933 |
| 312 | R | V | R | N | N | T | C | F | V | D | A | V | A | E | L | 9 | 12934 |
| 313 | V | R | N | N | T | C | F | V | D | A | V | A | E | L | A | 9 | 12935 |
| 325 | E | L | A | R | K | A | G | C | K | L | T | I | C | P | Q | 9 | 12936 |
| 337 | C | P | Q | A | E | N | R | N | D | R | W | I | Q | D | E | 9 | 12937 |
| 347 | W | I | Q | D | E | M | E | L | G | Y | V | Q | A | P | H | 9 | 12938 |
| 358 | Q | A | P | H | K | T | L | P | V | V | F | D | S | P | R | 9 | 12939 |
| 369 | D | S | P | R | N | G | E | L | Q | D | F | P | Y | K | R | 9 | 12940 |
| 396 | P | R | D | R | S | V | S | G | L | D | S | F | G | N | L | 9 | 12941 |
| 399 | R | S | V | S | G | L | D | S | F | G | N | L | E | V | S | 9 | 12942 |
| 402 | S | G | L | D | S | F | G | N | L | E | V | S | P | P | V | 9 | 12943 |
| 417 | V | A | N | G | K | E | Y | P | L | G | R | I | L | I | G | 9 | 12944 |
| 434 | L | P | G | S | S | S | G | R | R | V | T | Q | V | V | R | D | 9 | 12945 |
| 441 | R | V | T | Q | V | V | R | D | F | L | H | A | Q | K | V | 9 | 12946 |
| 442 | V | T | Q | V | V | R | D | F | L | H | A | Q | K | V | Q | 9 | 12947 |
| 451 | H | A | Q | K | V | Q | P | P | V | E | L | F | V | D | W | 9 | 12948 |
| 461 | L | F | V | D | W | L | A | V | G | H | V | D | E | F | L | 9 | 12949 |
| 464 | D | W | L | A | V | G | H | V | D | E | F | L | S | F | V | 9 | 12950 |
| 466 | L | A | V | G | H | V | D | E | F | L | S | F | V | P | A | 9 | 12951 |
| 467 | A | V | G | H | V | D | E | F | L | S | F | V | P | A | P | 9 | 12952 |
| 470 | H | V | D | E | F | L | S | F | V | P | A | P | D | G | K | 9 | 12953 |
| 480 | A | P | D | G | K | G | F | R | M | L | L | A | S | P | G | 9 | 12954 |
| 481 | P | D | G | K | G | F | R | M | L | L | A | S | P | G | A | 9 | 12955 |
| 488 | M | L | L | A | S | P | G | A | C | F | K | L | F | Q | E | 9 | 12956 |
| 489 | L | L | A | S | P | G | A | C | F | K | L | F | Q | E | K | 9 | 12957 |
| 495 | A | C | F | K | L | F | Q | E | K | Q | K | C | G | H | G | 9 | 12958 |
| 496 | C | F | K | L | F | Q | E | K | Q | K | C | G | H | G | R | 9 | 12959 |
| 502 | E | K | Q | K | C | G | H | G | R | A | L | L | F | Q | G | 9 | 12960 |
| 508 | H | G | R | A | L | L | F | Q | G | V | V | D | D | E | Q | 9 | 12961 |
| 519 | D | D | E | Q | V | K | T | I | S | I | N | Q | V | L | S | 9 | 12962 |
| 531 | V | L | S | N | K | D | L | I | N | Y | N | K | F | V | Q | 9 | 12963 |
| 554 | V | L | K | R | E | L | G | L | A | E | C | D | I | I | D | 9 | 12964 |
| 571 | Q | L | F | K | T | E | R | K | K | A | T | A | F | F | P | 9 | 12965 |
| 579 | K | A | T | A | F | F | P | D | L | V | N | M | L | V | L | 9 | 12966 |
| 604 | G | P | I | I | N | G | C | C | C | L | E | E | K | V | R | 9 | 12967 |
| 606 | I | I | N | G | C | C | C | L | E | E | K | V | R | S | L | 9 | 12968 |
| 609 | G | C | C | C | L | E | E | K | V | R | S | L | L | E | P | 9 | 12969 |
| 612 | C | L | E | E | K | V | R | S | L | L | E | P | L | G | L | 9 | 12970 |
| 613 | L | E | E | K | V | R | S | L | L | E | P | L | G | L | H | 9 | 12971 |
| 619 | S | L | L | E | P | L | G | L | H | C | T | F | I | D | D | 9 | 12972 |
| 629 | T | F | I | D | D | F | T | P | Y | H | M | L | H | G | E | 9 | 12973 |
| 636 | P | Y | H | M | L | H | G | E | V | H | C | G | T | N | V | 9 | 12974 |
| 645 | H | C | G | T | N | V | C | R | K | P | F | S | F | K | W | 9 | 12975 |
| 10 | S | L | E | H | P | T | S | A | V | C | V | A | G | V | E | 8 | 12976 |
| 13 | H | P | T | S | A | V | C | V | A | G | V | E | T | L | V | 8 | 12977 |
| 18 | V | C | V | A | G | V | E | T | L | V | D | I | Y | G | S | 8 | 12978 |
| 22 | G | V | E | T | L | V | D | I | Y | G | S | V | P | E | G | 8 | 12979 |
| 30 | Y | G | S | V | P | E | G | T | E | M | F | E | V | Y | G | 8 | 12980 |
| 43 | Y | G | T | P | G | V | D | I | Y | I | S | P | N | M | E | 8 | 12981 |
| 55 | N | M | E | R | G | R | E | R | A | D | T | R | R | W | R | 8 | 12982 |
| 59 | G | R | E | R | A | D | T | R | R | W | R | F | D | A | T | 8 | 12983 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 66 | R | R | W | R | F | D | A | T | L | E | I | I | V | V | M | 8 | 12984 |
| 79 | V | M | N | S | P | S | N | D | L | N | D | S | H | V | Q | 8 | 12985 |
| 83 | P | S | N | D | L | N | D | S | H | V | Q | I | S | Y | H | 8 | 12986 |
| 92 | V | Q | I | S | Y | H | S | S | H | E | P | L | P | L | A | 8 | 12987 |
| 95 | S | Y | H | S | S | H | E | P | L | P | L | A | Y | A | V | 8 | 12988 |
| 101 | E | P | L | P | L | A | Y | A | V | L | Y | L | T | C | V | 8 | 12989 |
| 102 | P | L | P | L | A | Y | A | V | L | Y | L | T | C | V | D | 8 | 12990 |
| 105 | L | A | Y | A | V | L | Y | L | T | C | V | D | I | S | L | 8 | 12991 |
| 113 | T | C | V | D | I | S | L | D | C | D | L | N | C | E | G | 8 | 12992 |
| 116 | D | I | S | L | D | C | D | L | N | C | E | G | R | Q | D | 8 | 12993 |
| 129 | Q | D | R | N | F | V | D | K | R | Q | W | V | W | G | P | 8 | 12994 |
| 166 | N | C | D | Q | H | V | H | C | L | Q | D | L | E | D | M | 8 | 12995 |
| 170 | H | V | H | C | L | Q | D | L | E | D | M | S | V | M | V | 8 | 12996 |
| 184 | V | L | R | T | Q | G | P | A | A | L | F | D | D | H | K | 8 | 12997 |
| 187 | T | Q | G | P | A | A | L | F | D | D | H | K | L | V | L | 8 | 12998 |
| 198 | K | L | V | L | H | T | S | S | Y | D | A | K | R | A | Q | 8 | 12999 |
| 202 | H | T | S | S | Y | D | A | K | R | A | Q | V | F | H | I | 8 | 13000 |
| 206 | Y | D | A | K | R | A | Q | V | F | H | I | C | G | P | E | 8 | 13001 |
| 214 | F | H | I | C | G | P | E | D | V | C | E | A | Y | R | H | 8 | 13002 |
| 227 | R | H | V | L | G | Q | D | K | V | S | Y | E | V | P | R | 8 | 13003 |
| 238 | E | V | P | R | L | H | G | D | E | R | F | F | V | E | | 8 | 13004 |
| 252 | E | G | L | S | F | P | D | A | G | F | T | G | L | I | S | 8 | 13005 |
| 271 | L | L | D | D | S | N | E | D | F | S | A | S | P | I | F | 8 | 13006 |
| 281 | A | S | P | I | F | T | D | T | V | V | F | R | V | A | P | 8 | 13007 |
| 299 | T | P | S | T | L | P | P | L | E | V | Y | V | C | R | V | 8 | 13008 |
| 315 | N | N | T | C | F | V | D | A | V | A | E | L | A | R | K | 8 | 13009 |
| 322 | A | V | A | E | L | A | R | K | A | G | C | K | L | T | I | 8 | 13010 |
| 332 | C | K | L | T | I | C | P | Q | A | E | N | R | N | D | R | 8 | 13011 |
| 341 | E | N | R | N | D | R | W | I | Q | D | E | M | E | L | G | 8 | 13012 |
| 342 | N | R | N | D | R | W | I | Q | D | E | M | E | L | G | Y | 8 | 13013 |
| 356 | Y | V | Q | A | P | H | K | T | L | P | V | V | F | D | S | 8 | 13014 |
| 366 | V | V | F | D | S | P | R | N | G | E | L | Q | D | F | P | 8 | 13015 |
| 370 | S | P | R | N | G | E | L | Q | D | F | P | Y | K | R | I | 8 | 13016 |
| 391 | Y | V | T | R | E | P | R | D | R | S | V | S | G | L | D | 8 | 13017 |
| 400 | S | V | S | G | L | D | S | F | G | N | L | E | V | S | P | 8 | 13018 |
| 403 | G | L | D | S | F | G | N | L | E | V | S | P | P | V | V | 8 | 13019 |
| 409 | N | L | E | V | S | P | P | V | V | A | N | G | K | E | Y | 8 | 13020 |
| 436 | G | S | S | G | R | R | V | T | Q | V | V | R | D | F | L | 8 | 13021 |
| 448 | D | F | L | H | A | Q | K | V | Q | P | P | V | E | L | F | 8 | 13022 |
| 458 | P | V | E | L | F | V | D | W | L | A | V | G | H | V | D | 8 | 13023 |
| 473 | E | F | L | S | F | V | P | A | P | D | G | K | G | F | R | 8 | 13024 |
| 498 | K | L | F | Q | E | K | Q | K | C | G | H | G | R | A | L | 8 | 13025 |
| 510 | R | A | L | L | F | Q | G | V | V | D | D | E | Q | V | K | 8 | 13026 |
| 528 | I | N | Q | V | L | S | N | K | D | L | I | N | Y | N | K | 8 | 13027 |
| 529 | N | Q | V | L | S | N | K | D | L | I | N | Y | N | K | F | 8 | 13028 |
| 534 | N | K | D | L | I | N | Y | N | K | F | V | Q | S | C | I | 8 | 13029 |
| 541 | N | K | F | V | Q | S | C | I | D | W | N | R | E | V | L | 8 | 13030 |
| 544 | V | Q | S | C | I | D | W | N | R | E | V | L | K | R | E | 8 | 13031 |
| 545 | Q | S | C | I | D | W | N | R | E | V | L | K | R | E | L | 8 | 13032 |
| 549 | D | W | N | R | E | V | L | K | R | E | L | G | L | A | E | 8 | 13033 |
| 559 | L | G | L | A | E | C | D | I | I | D | I | P | Q | L | F | 8 | 13034 |
| 576 | E | R | K | K | A | T | A | F | F | P | D | L | V | N | M | 8 | 13035 |
| 595 | K | H | L | G | I | P | K | P | F | G | P | I | I | N | G | 8 | 13036 |
| 597 | L | G | I | P | K | P | F | G | P | I | I | N | G | C | C | 8 | 13037 |
| 603 | F | G | P | I | I | N | G | C | C | L | E | E | K | V | | 8 | 13038 |
| 640 | L | H | G | E | V | H | C | G | T | N | V | C | R | K | P | 8 | 13039 |
| 641 | H | G | E | V | H | C | G | T | N | V | C | R | K | P | F | 8 | 13040 |
| 647 | G | T | N | V | C | R | K | P | F | S | F | K | W | W | N | 8 | 13041 |
| 33 | V | P | E | G | T | E | M | F | E | V | Y | G | T | P | G | 7 | 13042 |
| 38 | E | M | F | E | V | Y | G | T | P | G | V | D | I | Y | I | 7 | 13043 |
| 44 | G | T | P | G | V | D | I | Y | I | S | P | N | M | E | R | 7 | 13044 |
| 50 | I | Y | I | S | P | N | M | E | R | G | R | E | R | A | D | 7 | 13045 |
| 57 | E | R | G | R | E | R | A | D | T | R | R | W | R | F | D | 7 | 13046 |
| 82 | S | P | S | N | D | L | N | D | S | H | V | Q | I | S | Y | 7 | 13047 |
| 111 | Y | L | T | C | V | D | I | S | L | D | C | D | L | N | C | 7 | 13048 |
| 249 | F | F | V | E | G | L | S | F | P | D | A | G | F | T | G | 7 | 13049 |
| 259 | A | G | F | T | G | L | I | S | F | H | V | T | L | L | D | 7 | 13050 |
| 267 | F | H | V | T | L | L | D | D | S | N | E | D | F | S | A | 7 | 13051 |
| 304 | P | P | L | E | V | Y | V | C | R | V | R | N | N | T | C | 7 | 13052 |
| 362 | K | T | L | P | V | V | F | D | S | P | R | N | G | E | L | 7 | 13053 |
| 371 | P | R | N | G | E | L | Q | D | F | P | Y | K | R | I | L | 7 | 13054 |
| 372 | R | N | G | E | L | Q | D | F | P | Y | K | R | I | L | G | 7 | 13055 |
| 411 | E | V | S | P | P | V | V | A | N | G | K | E | Y | P | L | 7 | 13056 |
| 453 | Q | K | V | Q | P | P | V | E | L | F | V | D | W | L | A | 7 | 13057 |
| 565 | D | I | I | D | I | P | Q | L | F | K | T | E | R | K | K | 7 | 13058 |
| 567 | I | D | I | P | Q | L | F | K | T | E | R | K | K | A | T | 7 | 13059 |
| 2 | S | L | Q | R | I | V | R | V | S | L | E | H | P | T | S | 6 | 13060 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 70 | F | D | A | T | L | E | I | I | V | V | M | N | S | P | S | 6 | 13061 |
| 86 | D | L | N | D | S | H | V | Q | I | S | Y | H | S | S | H | 6 | 13062 |
| 90 | S | H | V | Q | I | S | Y | H | S | S | H | E | P | L | P | 6 | 13063 |
| 96 | Y | H | S | S | H | E | P | L | P | L | A | Y | A | V | L | 6 | 13064 |
| 103 | L | P | L | A | Y | A | V | L | Y | L | T | C | V | D | I | 6 | 13065 |
| 110 | L | Y | L | T | C | V | D | I | S | L | D | C | D | L | N | 6 | 13066 |
| 151 | L | V | N | C | D | R | D | D | P | S | C | D | V | Q | D | 6 | 13067 |
| 157 | D | D | P | S | C | D | V | Q | D | N | C | D | Q | H | V | 6 | 13068 |
| 158 | D | P | S | C | D | V | Q | D | N | C | D | Q | H | V | H | 6 | 13069 |
| 165 | D | N | C | D | Q | H | V | H | C | L | Q | D | L | E | D | 6 | 13070 |
| 176 | D | L | E | D | M | S | V | M | V | L | R | T | Q | G | P | 6 | 13071 |
| 207 | D | A | K | R | A | Q | V | F | H | I | C | G | P | E | D | 6 | 13072 |
| 216 | I | C | G | P | E | D | V | C | E | A | Y | R | H | V | L | 6 | 13073 |
| 233 | D | K | V | S | Y | E | V | P | R | L | H | G | D | E | E | 6 | 13074 |
| 263 | G | L | I | S | F | H | V | T | L | L | D | D | S | N | E | 6 | 13075 |
| 275 | S | N | E | D | F | S | A | S | P | I | F | T | D | T | V | 6 | 13076 |
| 296 | W | I | M | T | P | S | T | L | P | P | L | E | V | Y | V | 6 | 13077 |
| 324 | A | E | L | A | R | K | A | G | C | K | L | T | I | C | P | 6 | 13078 |
| 392 | V | T | R | E | P | R | D | R | S | V | S | G | L | D | S | 6 | 13079 |
| 394 | R | E | P | R | D | R | S | V | S | G | L | D | S | F | G | 6 | 13080 |
| 430 | I | G | G | N | L | P | G | S | S | G | R | R | V | T | Q | 6 | 13081 |
| 440 | R | R | V | T | Q | V | V | R | D | F | L | H | A | Q | K | 6 | 13082 |
| 524 | K | T | I | S | I | N | Q | V | L | S | N | K | D | L | I | 6 | 13083 |
| 539 | N | Y | N | K | F | V | Q | S | C | I | D | W | N | R | E | 6 | 13084 |
| 542 | K | F | V | Q | S | C | I | D | W | N | R | E | V | L | K | 6 | 13085 |
| 560 | G | L | A | E | C | D | I | I | D | I | P | Q | L | F | K | 6 | 13086 |
| 593 | L | G | K | H | L | G | I | P | K | P | F | G | P | I | I | 6 | 13087 |
| 638 | H | M | L | H | G | E | V | H | C | G | T | N | V | C | R | 6 | 13088 |
| 34 | P | E | G | T | E | M | F | E | V | Y | G | T | P | G | V | 4 | 13089 |
| 237 | Y | E | V | P | R | L | H | G | D | E | E | R | F | F | V | 4 | 13090 |
| 626 | L | H | C | T | F | I | D | D | F | T | P | Y | H | M | L | 4 | 13091 |
| 54 | P | N | M | E | R | G | R | E | R | A | D | T | R | R | W | 3 | 13092 |
| 56 | M | E | R | G | R | E | R | A | D | T | R | R | W | R | F | 3 | 13093 |
| 58 | R | G | R | E | R | A | D | T | R | R | W | R | F | D | A | 3 | 13094 |
| 127 | G | R | Q | D | R | N | F | V | D | K | R | Q | W | V | W | 3 | 13095 |
| 321 | D | A | V | A | E | L | A | R | K | A | G | C | K | L | T | 3 | 13096 |
| 380 | P | Y | K | R | I | L | G | P | D | F | G | Y | V | T | R | 3 | 13097 |
| 530 | Q | V | L | S | N | K | D | L | I | N | Y | N | K | F | V | 3 | 13098 |
| 568 | D | I | P | Q | L | F | K | T | E | R | K | K | A | T | A | 3 | 13099 |
| 62 | R | A | D | T | R | R | W | R | F | D | A | T | L | E | I | 2 | 13100 |
| 124 | N | C | E | G | R | Q | D | R | N | F | V | D | K | R | Q | 2 | 13101 |
| 199 | L | V | L | H | T | S | S | Y | D | A | K | R | A | Q | V | 2 | 13102 |
| 204 | S | S | Y | D | A | K | R | A | Q | V | F | H | I | C | G | 2 | 13103 |
| 209 | K | R | A | Q | V | F | H | I | C | G | P | E | D | V | C | 2 | 13104 |
| 221 | D | V | C | E | A | Y | R | H | V | L | G | Q | D | K | V | 2 | 13105 |
| 298 | M | T | P | S | T | L | P | P | L | E | V | Y | V | C | R | 2 | 13106 |
| 334 | L | T | I | C | P | Q | A | E | N | R | N | D | R | W | I | 2 | 13107 |
| 339 | Q | A | E | N | R | N | D | R | W | I | Q | D | E | M | E | 2 | 13108 |
| 377 | Q | D | F | P | Y | K | R | I | L | G | P | D | F | G | Y | 2 | 13109 |
| 384 | I | L | G | P | D | F | G | Y | V | T | R | E | P | R | D | 2 | 13110 |
| 415 | P | V | V | A | N | G | K | E | Y | P | L | G | R | I | L | 2 | 13111 |
| 421 | K | E | Y | P | L | G | R | I | L | I | G | N | L | P | 2 | 13112 |
| 432 | G | N | L | P | G | S | S | G | R | R | V | T | Q | V | V | 2 | 13113 |
| 437 | S | S | G | R | R | V | T | Q | V | V | R | D | F | L | H | 2 | 13114 |
| 445 | V | V | R | D | F | L | H | A | Q | K | V | Q | P | P | V | 2 | 13115 |
| 546 | S | C | I | D | W | N | R | E | V | L | K | R | E | L | G | 2 | 13116 |
| 599 | I | P | K | P | F | G | P | I | I | N | G | C | C | C | L | 2 | 13117 |
| 632 | D | D | F | T | P | Y | H | M | L | H | G | E | V | H | C | 2 | 13118 |
| 635 | T | P | Y | H | M | L | H | G | E | V | H | C | G | T | N | 2 | 13119 |
| 649 | N | V | C | R | K | P | F | S | F | K | W | W | N | M | V | 2 | 13120 |
| 11 | L | E | H | P | T | S | A | V | C | V | A | G | V | E | T | 1 | 13121 |
| 19 | C | V | A | G | V | E | T | L | V | D | I | Y | G | S | V | 1 | 13122 |
| 60 | R | E | R | A | D | T | R | R | W | R | F | D | A | T | L | 1 | 13123 |
| 118 | S | L | D | C | D | L | N | C | E | G | R | Q | D | R | N | 1 | 13124 |
| 126 | E | G | R | Q | D | R | N | F | V | D | K | R | Q | W | V | 1 | 13125 |
| 159 | P | S | C | D | V | Q | D | N | C | D | Q | H | V | H | C | 1 | 13126 |
| 162 | D | V | Q | D | N | C | D | Q | H | V | H | C | L | Q | D | 1 | 13127 |
| 167 | C | D | Q | H | V | H | C | L | Q | D | L | E | D | M | S | 1 | 13128 |
| 175 | Q | D | L | E | D | M | S | V | M | V | L | R | T | Q | G | 1 | 13129 |
| 201 | L | H | T | S | S | Y | D | A | K | R | A | Q | V | F | H | 1 | 13130 |
| 230 | L | G | Q | D | K | V | S | Y | E | V | P | R | L | H | G | 1 | 13131 |
| 235 | V | S | Y | E | V | P | R | L | H | G | D | E | E | R | F | 1 | 13132 |
| 277 | E | D | F | S | A | S | P | I | F | T | D | T | V | V | F | 1 | 13133 |
| 285 | F | T | D | T | V | V | F | R | V | A | P | W | I | M | T | 1 | 13134 |
| 301 | S | T | L | P | P | L | E | V | Y | V | C | R | V | R | N | 1 | 13135 |
| 318 | C | F | V | D | A | V | A | E | L | A | R | K | A | G | C | 1 | 13136 |
| 326 | L | A | R | K | A | G | C | K | L | T | I | C | P | Q | A | 1 | 13137 |

TABLE XLVIII-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 338 | P | Q | A | E | N | R | N | D | R | W | I | Q | D | E | M | 1 | 13138 |
| 340 | A | E | N | R | N | D | R | W | I | Q | D | E | M | E | L | 1 | 13139 |
| 367 | V | F | D | S | P | R | N | G | E | L | Q | D | F | P | Y | 1 | 13140 |
| 383 | R | I | L | G | P | D | F | G | Y | V | T | R | E | P | R | 1 | 13141 |
| 397 | R | D | R | S | V | S | G | L | D | S | F | G | N | L | E | 1 | 13142 |
| 408 | G | N | L | E | V | S | P | P | V | V | A | N | G | K | E | 1 | 13143 |
| 476 | S | F | V | P | A | P | D | G | K | G | F | R | M | L | L | 1 | 13144 |
| 492 | S | P | G | A | C | F | K | L | F | Q | E | K | Q | K | C | 1 | 13145 |
| 513 | L | F | Q | G | V | V | D | D | E | Q | V | K | T | I | S | 1 | 13146 |
| 575 | T | E | R | K | K | A | T | A | F | F | P | D | L | V | N | 1 | 13147 |
| 578 | K | K | A | T | A | F | F | P | D | L | V | N | M | L | V | 1 | 13148 |
| 598 | G | I | P | K | P | F | G | P | I | I | N | G | C | C | C | 1 | 13149 |
| 616 | K | V | R | S | L | L | E | P | L | G | L | H | C | T | F | 1 | 13150 |
| 650 | V | C | R | K | P | F | S | F | K | W | W | N | M | V | P | 1 | 13151 |
| 184P1E2 v.2: HLA Peptide Scoring Results DRB1*0101 15-mers SYFPEITHI ||||||||||||||||||
| 4 | V | A | P | W | I | M | T | P | S | T | L | A | P | L | E | 26 | 13152 |
| 3 | R | V | A | P | W | I | M | T | P | S | T | L | A | P | L | 23 | 13153 |
| 5 | A | P | W | I | M | T | P | S | T | L | A | P | L | E | V | 22 | 13154 |
| 8 | I | M | T | P | S | T | L | A | P | L | E | V | Y | V | C | 22 | 13155 |
| 1 | V | F | R | V | A | P | W | I | M | T | P | S | T | L | A | 17 | 13156 |
| 6 | P | W | I | M | T | P | S | T | L | A | P | L | E | V | Y | 17 | 13157 |
| 11 | P | S | T | L | A | P | L | E | V | Y | V | C | R | V | R | 17 | 13158 |
| 13 | T | L | A | P | L | V | Y | V | C | R | V | R | N | N | N | 14 | 13159 |
| 2 | F | R | V | A | P | W | I | M | T | P | S | T | L | A | P | 12 | 13160 |
| 14 | L | A | P | L | E | V | Y | V | C | R | V | R | N | N | T | 9 | 13161 |
| 7 | W | I | M | T | P | S | T | L | A | P | L | E | V | Y | V | 8 | 13162 |
| 10 | T | P | S | T | L | A | P | L | E | V | Y | V | C | R | V | 8 | 13163 |
| 15 | A | P | L | E | V | Y | V | C | R | V | R | N | N | T | C | 7 | 13164 |
| 9 | M | T | P | S | T | L | A | P | L | E | V | Y | V | C | R | 2 | 13165 |
| 12 | S | T | L | A | P | L | E | V | Y | V | C | R | V | R | N | 1 | 13166 |
| 184P1E2 v.3: HLA Peptide Scoring Results DRB1*0101 15-mers SYFPEITHI ||||||||||||||||||
| 10 | L | S | F | V | P | V | P | D | G | K | G | F | R | M | L | 27 | 13167 |
| 12 | F | V | P | V | P | D | G | K | G | F | R | M | L | L | A | 24 | 13168 |
| 3 | V | G | H | V | D | E | F | L | S | F | V | P | V | P | D | 22 | 13169 |
| 9 | F | L | S | F | V | P | V | P | D | G | K | G | F | R | M | 18 | 13170 |
| 4 | G | H | V | D | E | F | L | S | F | V | P | V | P | D | G | 17 | 13171 |
| 6 | V | D | E | F | L | S | F | V | P | V | P | D | G | K | G | 16 | 13172 |
| 7 | D | E | F | L | S | F | V | P | V | P | D | G | K | G | F | 15 | 13173 |
| 13 | V | P | V | P | D | G | K | G | F | R | M | L | L | A | S | 10 | 13174 |
| 14 | P | V | P | D | G | K | G | F | R | M | L | L | A | S | P | 10 | 13175 |
| 1 | L | A | V | G | H | V | D | E | F | L | S | F | V | P | V | 9 | 13176 |
| 2 | A | V | G | H | V | D | E | F | L | S | F | V | P | V | P | 9 | 13177 |
| 5 | H | V | D | E | F | L | S | F | V | P | V | P | D | G | K | 9 | 13178 |
| 15 | V | P | D | G | K | G | F | R | M | L | L | A | S | P | G | 9 | 13179 |
| 8 | E | F | L | S | F | V | P | V | P | D | G | K | G | F | R | 8 | 13180 |
| 11 | S | F | V | P | V | P | D | G | K | G | F | R | M | L | L | 2 | 13181' |

TABLE XLIX

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 184P1E2 v.1: HLA Peptide Scoring Results DRB1 0301 15-mers SYFPEITHI ||||||||||||||||||
| 268 | H | V | T | L | L | D | D | S | N | E | D | F | S | A | S | 37 | 13182 |
| 190 | P | A | A | L | F | D | D | H | K | L | V | L | H | T | S | 35 | 13183 |
| 239 | V | P | R | L | H | G | D | E | E | R | F | F | V | E | G | 35 | 13184 |
| 514 | F | Q | G | V | V | D | D | E | Q | V | K | T | I | S | I | 30 | 13185 |
| 580 | A | T | A | F | F | P | D | L | V | N | M | L | V | L | G | 29 | 13186 |
| 116 | D | I | S | L | D | C | D | L | N | C | E | G | R | Q | D | 27 | 13187 |
| 226 | Y | R | H | V | L | G | Q | D | K | V | S | Y | E | V | P | 27 | 13188 |
| 610 | C | C | C | L | E | E | K | V | R | S | L | L | E | P | L | 26 | 13189 |
| 219 | P | E | D | V | C | E | A | Y | R | H | V | L | G | Q | D | 25 | 13190 |
| 345 | D | R | W | I | Q | D | E | M | E | L | G | Y | V | Q | A | 25 | 13191 |
| 414 | P | P | V | V | A | N | G | K | E | Y | P | L | G | R | I | 25 | 13192 |
| 439 | G | R | R | V | T | Q | V | V | R | D | F | L | H | A | Q | 25 | 13193 |
| 114 | C | V | D | I | S | L | D | C | D | L | N | C | E | G | R | 23 | 13194 |
| 363 | T | L | P | V | V | F | D | S | P | R | N | G | E | L | Q | 23 | 13195 |
| 365 | P | V | V | F | D | S | P | R | N | G | E | L | Q | D | F | 23 | 13196 |
| 182 | V | M | V | L | R | T | Q | G | P | A | A | L | F | D | D | 22 | 13197 |
| 442 | V | T | Q | V | V | R | D | F | L | H | A | Q | K | V | Q | 22 | 13198 |
| 486 | F | R | M | L | L | A | S | P | G | A | C | F | K | L | F | 22 | 13199 |
| 100 | H | E | P | L | P | L | A | Y | A | V | L | Y | L | T | C | 21 | 13200 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 227 | R | H | V | L | G | Q | D | K | V | S | Y | E | V | P | R | 21 | 13201 |
| 261 | F | T | G | L | I | S | F | H | V | T | L | D | D | D | S | 21 | 13202 |
| 281 | A | S | P | I | F | T | D | T | V | V | F | R | V | A | P | 21 | 13203 |
| 382 | K | R | I | L | G | P | D | F | G | Y | V | T | R | E | P | 21 | 13204 |
| 399 | R | S | V | S | G | L | D | S | F | G | N | L | E | V | S | 21 | 13205 |
| 458 | P | V | E | L | F | V | D | W | L | A | V | G | H | V | D | 21 | 13206 |
| 562 | A | E | C | D | I | I | D | I | P | Q | L | F | K | T | E | 21 | 13207 |
| 76 | I | I | V | V | M | N | S | P | S | N | D | L | N | D | S | 20 | 13208 |
| 149 | I | L | L | V | N | C | D | R | D | D | P | S | C | D | V | 20 | 13209 |
| 215 | H | I | C | G | P | E | D | V | C | E | A | Y | R | H | V | 20 | 13210 |
| 295 | P | W | I | M | T | P | S | T | L | P | P | L | E | V | Y | 20 | 13211 |
| 425 | L | G | R | I | L | I | G | G | N | L | P | G | S | S | G | 20 | 13212 |
| 466 | L | A | V | G | H | V | D | E | F | L | S | F | V | P | A | 20 | 13213 |
| 587 | L | V | N | M | L | V | L | G | K | H | L | G | I | P | K | 20 | 13214 |
| 614 | E | E | K | V | R | S | L | L | E | P | L | G | L | H | C | 20 | 13215 |
| 15 | T | S | A | V | C | V | A | G | V | E | T | L | V | D | I | 19 | 13216 |
| 77 | I | V | V | M | N | S | P | S | N | D | L | N | D | S | H | 19 | 13217 |
| 112 | L | T | C | V | D | I | S | L | D | C | D | L | N | C | E | 19 | 13218 |
| 170 | H | V | H | C | L | Q | D | L | E | D | M | S | V | M | V | 19 | 13219 |
| 174 | L | Q | D | L | E | D | M | S | V | M | V | L | R | T | Q | 19 | 13220 |
| 315 | N | N | T | C | F | V | D | A | V | A | E | L | A | R | K | 19 | 13221 |
| 323 | V | A | E | L | A | R | K | A | G | C | K | L | T | I | C | 19 | 13222 |
| 331 | G | C | K | L | T | I | C | P | Q | A | E | N | R | N | D | 19 | 13223 |
| 401 | V | S | G | L | D | S | F | G | N | L | E | V | S | P | P | 19 | 13224 |
| 529 | N | Q | V | L | S | N | K | D | L | I | N | Y | N | K | F | 19 | 13225 |
| 563 | E | C | D | I | I | D | I | P | Q | L | F | K | T | E | R | 19 | 13226 |
| 627 | H | C | T | F | I | D | D | F | T | P | Y | H | M | L | H | 19 | 13227 |
| 4 | Q | R | I | V | R | V | S | L | E | H | P | T | S | A | V | 18 | 13228 |
| 120 | D | C | D | L | N | C | E | G | R | Q | D | R | N | F | V | 18 | 13229 |
| 129 | Q | D | R | N | F | V | D | K | R | Q | W | V | W | G | P | 18 | 13230 |
| 180 | M | S | V | M | V | L | R | T | Q | G | P | A | A | L | F | 18 | 13231 |
| 317 | T | C | F | V | D | A | V | A | E | L | A | R | K | A | G | 18 | 13232 |
| 320 | V | D | A | V | A | E | L | A | R | K | A | G | C | K | L | 18 | 13233 |
| 333 | K | L | T | I | C | P | Q | A | E | N | R | N | D | R | W | 18 | 13234 |
| 364 | L | P | V | V | F | D | S | P | R | N | G | E | L | Q | D | 18 | 13235 |
| 389 | F | G | Y | V | T | R | E | P | R | D | R | S | V | S | G | 18 | 13236 |
| 413 | S | P | P | V | V | A | N | G | K | E | Y | P | L | G | R | 18 | 13237 |
| 452 | A | Q | K | V | Q | P | P | V | E | L | F | V | D | W | L | 18 | 13238 |
| 463 | V | D | W | L | A | V | G | H | V | D | E | F | L | S | F | 18 | 13239 |
| 475 | L | S | F | V | P | A | P | D | G | K | G | F | R | M | L | 18 | 13240 |
| 476 | S | F | V | P | A | P | D | G | K | G | F | R | M | L | L | 18 | 13241 |
| 513 | L | F | Q | G | V | V | D | D | E | Q | V | K | T | I | S | 18 | 13242 |
| 545 | Q | S | C | I | D | W | N | R | E | V | L | K | R | E | L | 18 | 13243 |
| 569 | I | P | Q | L | F | K | T | E | R | K | K | A | T | A | F | 18 | 13244 |
| 623 | P | L | G | L | H | C | T | F | I | D | D | F | T | P | Y | 18 | 13245 |
| 626 | L | H | C | T | F | I | D | D | F | T | P | Y | H | M | L | 18 | 13246 |
| 30 | Y | G | S | V | P | E | G | T | E | M | F | E | V | Y | G | 17 | 13247 |
| 47 | G | V | D | I | Y | I | S | P | N | M | E | R | G | R | E | 17 | 13248 |
| 49 | D | I | Y | I | S | P | N | M | E | R | G | R | E | R | A | 17 | 13249 |
| 53 | S | P | N | M | E | R | G | R | E | R | A | D | T | R | R | 17 | 13250 |
| 58 | R | G | R | E | R | A | D | T | R | R | W | R | F | D | A | 17 | 13251 |
| 73 | T | L | E | I | I | V | V | M | N | S | P | S | N | D | L | 17 | 13252 |
| 80 | M | N | S | P | S | N | D | L | N | D | S | H | V | Q | I | 17 | 13253 |
| 124 | N | C | E | G | R | Q | D | R | N | F | V | D | K | R | Q | 17 | 13254 |
| 148 | G | I | L | L | V | N | C | D | R | D | D | P | S | C | D | 17 | 13255 |
| 156 | R | D | D | P | S | C | D | V | Q | D | N | C | D | Q | H | 17 | 13256 |
| 201 | L | H | T | S | S | Y | D | A | K | R | A | Q | V | F | H | 17 | 13257 |
| 253 | G | L | S | F | P | D | A | G | F | T | G | L | I | S | F | 17 | 13258 |
| 307 | E | V | Y | V | C | R | V | R | N | N | T | C | F | V | D | 17 | 13259 |
| 354 | L | G | Y | V | Q | A | P | H | K | T | L | P | V | V | F | 17 | 13260 |
| 446 | V | R | D | F | L | H | A | Q | K | V | Q | P | P | V | E | 17 | 13261 |
| 465 | W | L | A | V | G | H | V | D | E | F | L | S | F | V | P | 17 | 13262 |
| 496 | C | F | K | L | F | Q | E | K | Q | K | C | G | H | G | R | 17 | 13263 |
| 502 | E | K | Q | K | C | G | H | G | R | A | L | L | F | Q | G | 17 | 13264 |
| 534 | N | K | D | L | I | N | Y | N | K | F | V | Q | S | C | I | 17 | 13265 |
| 548 | I | D | W | N | R | E | V | L | K | R | E | L | G | L | A | 17 | 13266 |
| 550 | W | N | R | E | V | L | K | R | E | L | G | L | A | E | C | 17 | 13267 |
| 641 | H | G | E | V | H | C | G | T | N | V | C | R | K | P | F | 17 | 13268 |
| 238 | E | V | P | R | L | H | G | D | E | E | R | F | V | E | 16 | 13269 |
| 269 | V | T | L | L | D | D | S | N | E | D | F | S | A | S | P | 16 | 13270 |
| 494 | G | A | C | F | K | L | F | Q | E | K | Q | K | C | G | H | 16 | 13271 |
| 521 | E | Q | V | K | T | I | S | I | N | Q | V | L | S | N | K | 16 | 13272 |
| 543 | F | V | Q | S | C | I | D | W | N | R | E | V | L | K | R | 16 | 13273 |
| 566 | I | I | D | I | P | Q | L | F | K | T | E | R | K | K | A | 16 | 13274 |
| 570 | P | Q | L | F | K | T | E | R | K | K | A | T | A | F | F | 16 | 13275 |
| 67 | R | W | R | F | D | A | T | L | E | I | I | V | V | M | N | 15 | 13276 |
| 85 | N | D | L | N | D | S | H | V | Q | I | S | Y | H | S | S | 15 | 13277 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 130 | D | R | N | F | V | D | K | R | Q | W | V | W | G | P | S | 15 | 13278 |
| 308 | V | Y | V | C | R | V | R | N | N | T | C | F | V | D | A | 15 | 13279 |
| 479 | P | A | P | D | G | K | G | F | R | M | L | L | A | S | P | 15 | 13280 |
| 485 | G | F | R | M | L | L | A | S | P | G | A | C | F | K | L | 15 | 13281 |
| 497 | F | K | L | F | Q | E | K | Q | K | C | G | H | G | R | A | 15 | 13282 |
| 526 | I | S | I | N | Q | V | L | S | N | K | D | L | I | N | Y | 15 | 13283 |
| 528 | I | N | Q | V | L | S | N | K | D | L | I | N | Y | N | K | 15 | 13284 |
| 544 | V | Q | S | C | I | D | W | N | R | E | V | L | K | R | E | 15 | 13285 |
| 581 | T | A | F | F | P | D | L | V | N | M | L | V | L | G | K | 15 | 13286 |
| 600 | P | K | P | F | G | P | I | I | N | G | C | C | C | L | E | 15 | 13287 |
| 617 | V | R | S | L | L | E | P | L | G | L | H | C | T | F | I | 15 | 13288 |
| 644 | V | H | C | G | T | N | V | C | R | K | P | F | S | F | K | 15 | 13289 |
| 59 | G | R | E | R | A | D | T | R | R | W | R | F | D | A | T | 14 | 13290 |
| 75 | E | I | I | V | V | M | N | S | P | S | N | D | L | N | D | 14 | 13291 |
| 83 | P | S | N | D | L | N | D | S | H | V | Q | I | S | Y | H | 14 | 13292 |
| 173 | C | L | Q | D | L | E | D | M | S | V | M | V | L | R | T | 14 | 13293 |
| 267 | F | H | V | T | L | L | D | D | S | N | E | D | F | S | A | 14 | 13294 |
| 343 | R | N | D | R | W | I | Q | D | E | M | E | L | G | Y | V | 14 | 13295 |
| 374 | G | E | L | Q | D | F | P | Y | K | R | I | L | G | P | D | 14 | 13296 |
| 386 | G | P | D | F | G | Y | V | T | R | E | P | R | D | R | S | 14 | 13297 |
| 509 | G | R | A | L | L | F | Q | G | V | V | D | D | E | Q | V | 14 | 13298 |
| 551 | N | R | E | V | L | K | R | E | L | G | L | A | E | C | D | 14 | 13299 |
| 552 | R | E | V | L | K | R | E | L | G | L | A | E | C | D | I | 14 | 13300 |
| 588 | V | N | M | L | V | L | G | K | H | L | G | I | P | K | P | 14 | 13301 |
| 106 | A | Y | A | V | L | Y | L | T | C | V | D | I | S | L | D | 13 | 13302 |
| 146 | Y | G | G | I | L | L | V | N | C | D | R | D | D | P | S | 13 | 13303 |
| 181 | S | V | M | V | L | R | T | Q | G | P | A | A | L | F | D | 13 | 13304 |
| 189 | G | P | A | A | L | F | D | D | H | K | L | V | L | H | T | 13 | 13305 |
| 197 | H | K | L | V | L | H | T | S | S | Y | D | A | K | R | A | 13 | 13306 |
| 250 | F | V | E | G | L | S | F | P | D | A | G | F | T | G | L | 13 | 13307 |
| 266 | S | F | H | V | T | L | L | D | D | S | N | E | D | F | S | 13 | 13308 |
| 344 | N | D | R | W | I | Q | D | E | M | E | L | G | Y | V | Q | 13 | 13309 |
| 349 | Q | D | E | M | E | L | G | Y | V | W | A | P | H | K | T | 13 | 13310 |
| 372 | R | N | G | E | L | Q | D | F | P | Y | K | R | I | L | G | 13 | 13311 |
| 409 | N | L | E | V | S | P | P | V | V | A | N | G | K | E | Y | 13 | 13312 |
| 443 | T | Q | V | V | R | D | F | L | H | A | Q | K | V | Q | P | 13 | 13313 |
| 520 | D | E | Q | V | K | T | I | S | I | N | Q | V | L | S | N | 13 | 13314 |
| 525 | T | I | S | I | N | Q | V | L | S | N | K | D | L | I | N | 13 | 13315 |
| 584 | F | P | D | L | V | N | M | L | V | L | G | K | H | L | G | 13 | 13316 |
| 636 | P | Y | H | M | L | H | G | E | V | H | C | G | T | N | V | 13 | 13317 |
| 3 | L | Q | R | I | V | R | V | S | L | E | H | P | T | S | A | 12 | 13318 |
| 17 | A | V | C | V | A | G | V | E | T | L | V | D | I | Y | G | 12 | 13319 |
| 22 | G | V | E | T | L | V | D | I | Y | G | S | V | P | E | G | 12 | 13320 |
| 24 | E | T | L | V | D | I | Y | G | S | V | P | E | G | T | E | 12 | 13321 |
| 39 | M | F | E | V | Y | G | T | P | G | V | D | I | Y | I | S | 12 | 13322 |
| 65 | T | R | R | W | R | F | D | A | T | L | E | I | I | V | V | 12 | 13323 |
| 96 | Y | H | S | S | H | E | P | L | P | L | A | Y | A | V | L | 12 | 13324 |
| 99 | S | H | E | P | L | P | L | A | Y | A | V | L | Y | L | T | 12 | 13325 |
| 109 | V | L | Y | L | T | C | V | D | I | S | L | D | C | D | L | 12 | 13326 |
| 147 | G | G | I | L | L | V | N | C | D | R | D | D | P | S | C | 12 | 13327 |
| 152 | V | N | C | D | R | D | D | P | S | C | D | V | Q | D | N | 12 | 13328 |
| 183 | M | V | L | R | T | Q | G | P | A | A | L | F | D | D | H | 12 | 13329 |
| 196 | D | H | K | L | V | L | H | T | S | S | Y | D | A | K | R | 12 | 13330 |
| 198 | K | L | V | L | H | T | S | S | Y | D | A | K | R | A | Q | 12 | 13331 |
| 213 | V | F | H | I | C | G | P | E | D | V | C | E | A | Y | R | 12 | 13332 |
| 262 | T | G | L | I | S | F | H | V | T | L | L | D | D | S | N | 12 | 13333 |
| 272 | L | D | D | S | N | E | D | F | S | A | S | P | I | F | T | 12 | 13334 |
| 294 | A | P | W | I | M | T | P | S | T | L | P | P | L | E | V | 12 | 13335 |
| 300 | P | S | T | L | P | P | L | E | V | Y | V | C | R | V | R | 12 | 13336 |
| 381 | Y | K | R | I | L | G | P | D | F | G | Y | V | T | R | E | 12 | 13337 |
| 407 | F | G | N | L | E | V | S | P | P | V | V | A | N | G | K | 12 | 13338 |
| 447 | R | D | F | L | H | A | Q | K | V | Q | P | P | V | E | L | 12 | 13339 |
| 456 | Q | P | P | V | E | L | F | V | D | W | L | A | V | G | H | 12 | 13340 |
| 468 | V | G | H | V | D | E | F | L | S | F | V | P | A | P | D | 12 | 13341 |
| 471 | V | D | E | F | L | S | F | V | P | A | P | D | G | K | G | 12 | 13342 |
| 474 | F | L | S | F | V | P | A | P | D | G | K | G | F | R | M | 12 | 13343 |
| 487 | R | M | L | L | A | S | P | G | A | C | F | K | L | F | Q | 12 | 13344 |
| 530 | Q | V | L | S | N | K | D | L | I | N | Y | N | K | F | V | 12 | 13345 |
| 535 | K | D | L | I | N | Y | N | K | F | V | Q | S | C | I | D | 12 | 13346 |
| 541 | N | K | F | V | Q | S | C | I | D | W | N | R | E | V | L | 12 | 13347 |
| 556 | K | R | E | L | G | L | A | E | C | D | I | I | D | I | P | 12 | 13348 |
| 585 | P | D | L | V | N | M | L | V | L | G | K | H | L | G | I | 12 | 13349 |
| 589 | N | M | L | V | L | G | K | H | L | G | I | P | K | P | F | 12 | 13350 |
| 603 | F | G | P | I | I | N | G | C | C | C | L | E | E | K | V | 12 | 13351 |
| 609 | G | C | C | C | L | E | E | K | V | R | S | L | L | E | P | 12 | 13352 |
| 618 | R | S | L | L | E | P | L | G | L | H | C | T | F | I | D | 12 | 13353 |
| 6 | I | V | R | V | S | L | E | H | P | T | S | A | V | C | V | 11 | 13354 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 8 | R | V | S | L | E | H | P | T | S | A | V | C | V | A | G | 11 | 13355 |
| 19 | C | V | A | G | V | E | T | L | V | D | I | Y | G | S | V | 11 | 13356 |
| 23 | V | E | T | L | V | D | I | Y | G | S | V | P | E | G | T | 11 | 13357 |
| 29 | I | Y | G | S | V | P | E | G | T | E | M | F | E | V | Y | 11 | 13358 |
| 36 | G | T | E | M | F | E | V | Y | G | T | P | G | V | D | I | 11 | 13359 |
| 45 | T | P | G | V | D | I | Y | I | S | P | N | M | E | R | G | 11 | 13360 |
| 71 | D | A | T | L | E | I | I | V | V | M | N | S | P | S | N | 11 | 13361 |
| 74 | L | E | I | I | V | V | M | N | S | P | S | N | D | L | N | 11 | 13362 |
| 84 | S | N | D | L | N | D | S | H | V | Q | I | S | Y | H | S | 11 | 13363 |
| 91 | H | V | Q | I | S | Y | H | S | S | H | E | P | L | P | L | 11 | 13364 |
| 94 | I | S | Y | H | S | S | H | E | P | L | P | L | A | Y | A | 11 | 13365 |
| 101 | E | P | L | P | L | A | Y | A | V | L | Y | L | T | C | V | 11 | 13366 |
| 102 | P | L | P | L | A | Y | A | V | L | Y | L | T | C | V | D | 11 | 13367 |
| 107 | Y | A | V | L | Y | L | T | C | V | D | I | S | L | D | C | 11 | 13368 |
| 110 | L | Y | L | T | C | V | D | I | S | L | D | C | D | L | N | 11 | 13369 |
| 131 | R | N | F | V | D | K | R | Q | W | V | W | G | P | S | G | 11 | 13370 |
| 137 | R | Q | W | V | W | G | P | S | G | Y | G | G | I | L | L | 11 | 13371 |
| 159 | P | S | C | D | V | Q | D | N | C | D | Q | H | V | H | C | 11 | 13372 |
| 160 | S | C | D | V | Q | D | N | C | D | Q | H | V | H | C | L | 11 | 13373 |
| 162 | D | V | Q | D | N | C | D | Q | H | V | H | C | L | Q | D | 11 | 13374 |
| 168 | D | Q | H | V | H | C | L | Q | D | L | E | D | M | S | V | 11 | 13375 |
| 171 | V | H | C | L | Q | D | L | E | D | M | S | V | M | V | L | 11 | 13376 |
| 179 | D | M | S | V | M | V | L | R | T | Q | G | P | A | A | L | 11 | 13377 |
| 191 | A | A | L | F | D | D | H | K | L | V | L | H | T | S | S | 11 | 13378 |
| 231 | G | Q | D | K | V | S | Y | E | V | P | R | L | H | G | D | 11 | 13379 |
| 232 | Q | D | K | V | S | Y | E | V | P | R | L | H | G | D | E | 11 | 13380 |
| 247 | E | R | F | F | V | E | G | L | S | F | P | D | A | G | F | 11 | 13381 |
| 248 | R | F | F | V | E | G | L | S | F | P | D | A | G | F | T | 11 | 13382 |
| 252 | E | G | L | S | F | P | D | A | G | F | T | G | L | I | S | 11 | 13383 |
| 260 | G | F | T | G | L | I | S | F | H | V | T | L | L | D | D | 11 | 13384 |
| 286 | T | D | T | V | V | F | R | V | A | P | W | I | M | T | P | 11 | 13385 |
| 290 | V | F | R | V | A | P | W | I | M | T | P | S | T | L | P | 11 | 13386 |
| 298 | M | T | P | S | T | L | P | P | L | E | V | Y | V | C | R | 11 | 13387 |
| 299 | T | P | S | T | L | P | P | L | E | V | Y | V | C | R | V | 11 | 13388 |
| 305 | P | L | E | V | Y | V | C | R | V | R | N | N | T | C | F | 11 | 13389 |
| 310 | V | C | R | V | R | N | N | T | C | F | V | D | A | V | A | 11 | 13390 |
| 339 | Q | A | E | N | R | N | D | R | W | I | Q | D | E | M | E | 11 | 13391 |
| 368 | F | D | S | P | R | N | G | E | L | Q | D | F | P | Y | K | 11 | 13392 |
| 373 | N | G | E | L | Q | D | F | P | Y | K | R | I | L | G | P | 11 | 13393 |
| 380 | P | Y | K | R | I | L | G | P | D | F | G | Y | V | T | R | 11 | 13394 |
| 392 | V | T | R | E | P | R | D | R | S | V | S | G | L | D | S | 11 | 13395 |
| 422 | E | Y | P | L | G | R | I | L | I | G | G | N | L | P | G | 11 | 13396 |
| 426 | G | R | I | L | I | G | G | N | L | P | G | S | S | G | R | 11 | 13397 |
| 427 | R | I | L | I | G | G | N | L | P | G | S | S | G | R | R | 11 | 13398 |
| 431 | G | G | N | L | P | G | S | S | G | R | R | V | T | Q | V | 11 | 13399 |
| 450 | L | H | A | Q | K | V | Q | P | P | V | E | L | F | V | D | 11 | 14400 |
| 451 | H | A | Q | K | V | Q | P | P | V | E | L | F | V | D | W | 11 | 13401 |
| 459 | V | E | L | F | V | D | W | L | A | V | G | H | V | D | E | 11 | 13402 |
| 472 | D | E | F | L | S | F | V | P | A | P | D | G | K | G | F | 11 | 13403 |
| 483 | G | K | G | F | R | M | L | L | A | S | P | G | A | C | F | 11 | 13404 |
| 495 | A | C | F | K | L | F | Q | E | K | Q | K | C | G | H | G | 11 | 13405 |
| 523 | V | K | T | I | S | I | N | Q | V | L | S | N | K | D | L | 11 | 13406 |
| 532 | L | S | N | D | K | L | I | N | Y | N | K | F | V | Q | S | 11 | 13407 |
| 558 | E | L | G | L | A | E | C | D | I | I | D | I | P | Q | L | 11 | 13408 |
| 564 | C | D | I | I | D | I | P | Q | L | F | K | T | E | R | K | 11 | 13409 |
| 590 | M | L | V | L | G | K | H | L | G | I | P | K | P | F | G | 11 | 13410 |
| 594 | G | K | H | L | G | I | P | K | P | F | G | P | I | I | N | 11 | 13411 |
| 604 | G | P | I | I | N | G | C | C | C | L | E | E | K | V | R | 11 | 13412 |
| 615 | E | K | V | R | S | L | L | E | P | L | G | L | H | C | T | 11 | 13413 |
| 621 | L | E | P | L | G | L | H | C | T | F | I | D | D | F | T | 11 | 13414 |
| 631 | I | D | D | F | T | P | Y | H | M | L | H | G | E | V | H | 11 | 13415 |
| 647 | G | T | N | V | C | R | K | P | F | S | F | K | W | W | N | 11 | 13416 |
| 20 | V | A | G | V | E | T | L | V | D | I | Y | G | S | V | P | 10 | 13417 |
| 26 | L | V | D | I | Y | G | S | V | P | E | G | T | E | M | F | 10 | 13418 |
| 43 | Y | G | T | P | G | V | D | I | Y | I | S | P | N | M | E | 10 | 13419 |
| 63 | A | D | T | R | R | W | R | F | D | A | T | L | E | I | I | 10 | 13420 |
| 89 | D | S | H | V | Q | I | S | Y | H | S | S | H | E | P | L | 10 | 13421 |
| 108 | A | V | L | Y | L | T | C | V | D | I | S | L | D | C | D | 10 | 13422 |
| 140 | V | W | G | P | S | G | Y | G | G | I | L | L | V | N | C | 10 | 13423 |
| 151 | L | V | N | C | D | R | D | D | P | S | C | D | V | Q | D | 10 | 13424 |
| 177 | L | E | D | M | S | V | M | V | L | R | T | Q | G | P | A | 10 | 13425 |
| 188 | Q | G | P | A | A | L | F | D | D | H | K | L | V | L | H | 10 | 13426 |
| 195 | D | D | H | K | L | V | L | H | T | S | S | Y | D | A | K | 10 | 13427 |
| 210 | R | A | Q | V | F | H | I | C | G | P | E | D | V | C | E | 10 | 13428 |
| 236 | S | Y | E | V | P | R | L | H | G | D | E | E | R | F | F | 10 | 13429 |
| 245 | D | E | E | R | F | F | V | E | G | L | S | F | P | D | A | 10 | 13430 |
| 251 | V | E | G | L | S | F | P | D | A | G | F | T | G | L | I | 10 | 13431 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 280 | S | A | S | P | I | F | T | D | T | V | V | F | R | V | A | 10 | 13432 |
| 287 | D | T | V | V | F | R | V | A | P | W | I | M | T | P | S | 10 | 13433 |
| 288 | T | V | V | F | R | V | A | P | W | I | M | T | P | S | T | 10 | 13434 |
| 303 | L | P | P | L | E | V | Y | V | C | R | V | R | N | N | T | 10 | 13435 |
| 316 | N | T | C | F | V | D | A | V | A | E | L | A | R | K | A | 10 | 13436 |
| 351 | E | M | E | L | G | Y | V | Q | A | P | H | K | T | L | P | 10 | 13437 |
| 353 | E | L | G | Y | V | Q | A | P | H | K | T | L | P | V | V | 10 | 13438 |
| 357 | V | Q | A | P | H | K | T | L | P | V | V | F | D | S | P | 10 | 13439 |
| 361 | H | K | T | L | P | V | V | F | D | S | P | R | N | G | E | 10 | 13440 |
| 378 | D | F | P | Y | K | R | I | L | G | P | D | F | G | Y | V | 10 | 13441 |
| 393 | T | R | E | P | R | D | R | S | V | S | G | L | D | S | F | 10 | 13442 |
| 398 | D | R | S | V | S | G | L | D | S | F | G | N | L | E | V | 10 | 13443 |
| 423 | Y | P | L | G | R | I | L | I | G | G | N | L | P | G | S | 10 | 13444 |
| 455 | V | Q | P | P | V | E | L | F | V | D | W | L | A | V | G | 10 | 13445 |
| 460 | E | L | F | V | D | W | L | A | V | G | H | V | D | E | F | 10 | 13446 |
| 488 | M | L | L | A | S | P | G | A | C | F | K | L | F | Q | E | 10 | 13447 |
| 501 | Q | E | K | Q | K | C | G | H | G | R | A | L | L | F | Q | 10 | 13448 |
| 503 | K | Q | K | C | G | H | G | R | A | L | L | F | Q | G | V | 10 | 13449 |
| 510 | R | A | L | L | F | Q | G | V | V | D | D | E | Q | V | K | 10 | 13450 |
| 515 | Q | G | V | V | D | D | E | Q | V | K | T | I | S | I | N | 10 | 13451 |
| 522 | Q | V | K | T | I | S | I | N | Q | V | L | S | N | K | D | 10 | 13452 |
| 559 | L | G | L | A | E | C | D | I | I | D | I | P | Q | L | F | 10 | 13453 |
| 571 | Q | L | F | K | T | E | R | K | K | A | T | A | F | F | P | 10 | 13454 |
| 572 | L | F | K | T | E | R | K | K | A | T | A | F | F | P | D | 10 | 13455 |
| 573 | F | K | T | E | R | K | K | A | T | A | F | F | P | D | L | 10 | 13456 |
| 582 | A | F | F | P | D | L | V | N | M | L | V | L | G | K | H | 10 | 13457 |
| 586 | D | L | V | N | M | L | V | L | G | K | H | L | G | I | P | 10 | 13458 |
| 596 | H | L | G | I | P | K | P | F | G | P | I | I | N | G | C | 10 | 13459 |
| 602 | P | F | G | P | I | I | N | G | C | C | L | E | E | K | 10 | 13460 |
| 613 | L | E | E | K | V | R | S | L | L | E | P | L | G | L | H | 10 | 13461 |
| 619 | S | L | L | E | P | L | G | L | H | C | T | F | I | D | D | 10 | 13462 |
| 628 | C | T | F | I | D | D | F | T | P | Y | H | M | L | H | G | 10 | 13463 |
| 637 | Y | H | M | L | H | G | E | V | H | C | G | T | N | V | C | 10 | 13464 |
| 646 | C | G | T | N | V | C | R | K | P | F | S | F | K | W | W | 10 | 13465 |
| 33 | V | P | E | G | T | E | M | F | E | V | Y | G | T | P | G | 9 | 13466 |
| 37 | T | E | M | F | E | V | Y | G | T | P | G | V | D | I | Y | 9 | 13467 |
| 40 | F | E | V | Y | G | T | P | G | V | D | I | Y | I | S | P | 9 | 13468 |
| 54 | P | N | M | E | R | G | R | E | R | A | D | T | R | R | W | 9 | 13469 |
| 92 | V | Q | I | S | Y | H | S | S | H | E | P | L | P | L | A | 9 | 13470 |
| 122 | D | L | N | C | E | G | R | Q | D | R | N | F | V | D | K | 9 | 13471 |
| 135 | D | K | R | Q | W | V | W | G | P | S | G | Y | G | G | I | 9 | 13472 |
| 139 | W | V | W | G | P | S | G | Y | G | G | I | L | L | V | N | 9 | 13473 |
| 166 | N | C | D | Q | H | V | H | C | L | Q | D | L | E | D | M | 9 | 13474 |
| 167 | C | D | Q | H | V | H | C | L | Q | D | L | E | D | M | S | 9 | 13475 |
| 178 | E | D | M | S | V | M | V | L | R | T | Q | G | P | A | A | 9 | 13476 |
| 203 | T | S | S | Y | D | A | K | R | A | Q | V | F | H | I | C | 9 | 13477 |
| 211 | A | Q | V | F | H | I | C | G | P | E | D | V | C | E | A | 9 | 13478 |
| 233 | D | K | V | S | Y | E | V | P | R | L | H | G | D | E | E | 9 | 13479 |
| 246 | E | E | R | F | F | V | E | G | L | S | F | P | D | A | G | 9 | 13480 |
| 256 | F | P | D | A | G | F | T | G | L | I | S | F | H | V | T | 9 | 13481 |
| 258 | D | A | G | F | T | G | L | I | S | F | H | V | T | L | L | 9 | 13482 |
| 264 | L | I | S | F | H | V | T | L | L | D | D | S | N | E | D | 9 | 13483 |
| 276 | N | E | D | F | S | A | S | P | I | F | T | D | T | V | V | 9 | 13484 |
| 282 | S | P | I | F | T | D | T | V | V | F | R | V | A | P | W | 9 | 13485 |
| 284 | I | F | T | D | T | V | V | F | R | V | A | P | W | I | M | 9 | 13486 |
| 306 | L | E | V | Y | V | C | R | V | R | N | N | T | C | F | V | 9 | 13487 |
| 350 | D | E | M | E | L | G | Y | V | Q | A | P | H | K | T | L | 9 | 13488 |
| 370 | S | P | R | N | G | E | L | Q | D | F | P | Y | K | R | I | 9 | 13489 |
| 375 | E | L | Q | D | F | P | Y | K | R | I | L | G | P | D | F | 9 | 13490 |
| 376 | L | Q | D | F | P | Y | K | R | I | L | G | P | D | F | G | 9 | 13491 |
| 396 | P | R | D | R | S | V | S | G | L | D | S | F | G | N | L | 9 | 13492 |
| 404 | L | D | S | F | G | N | L | E | V | S | P | P | V | V | A | 9 | 13493 |
| 412 | V | S | P | P | V | V | A | N | G | K | E | Y | P | L | G | 9 | 13494 |
| 418 | A | N | G | K | E | Y | P | L | G | R | I | L | I | G | G | 9 | 13495 |
| 419 | N | G | K | E | Y | P | L | G | R | I | L | I | G | G | N | 9 | 13496 |
| 438 | S | G | R | R | V | T | Q | V | V | R | D | F | L | H | A | 9 | 13497 |
| 464 | D | W | L | A | V | G | H | V | D | E | F | L | S | F | V | 9 | 13498 |
| 478 | V | P | A | P | D | G | K | G | F | R | M | L | L | A | S | 9 | 13499 |
| 489 | L | L | A | S | P | G | A | C | F | K | L | F | Q | E | K | 9 | 13500 |
| 527 | S | I | N | Q | V | L | S | N | K | D | L | I | N | Y | N | 9 | 13501 |
| 540 | Y | N | K | F | V | Q | S | C | I | D | W | N | R | E | V | 9 | 13502 |
| 568 | D | I | P | Q | L | F | K | T | E | R | K | K | A | T | A | 9 | 13503 |
| 592 | V | L | G | K | H | L | G | I | P | K | P | F | G | P | I | 9 | 13504 |
| 593 | L | G | K | H | L | G | I | P | K | P | F | G | P | I | I | 9 | 13505 |
| 608 | N | G | C | C | L | E | E | K | V | R | S | L | L | E | 9 | 13506 |
| 629 | T | F | I | D | D | F | T | P | Y | H | M | L | H | G | E | 9 | 13507 |
| 635 | T | P | Y | H | M | L | H | G | E | V | H | C | G | T | N | 9 | 13508 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 16 | S | A | V | C | V | A | G | V | E | T | L | V | D | I | Y | 8 | 13509 |
| 27 | V | D | I | Y | G | S | V | P | E | G | T | E | M | F | E | 8 | 13510 |
| 32 | S | V | P | E | G | T | E | M | F | E | V | Y | G | T | P | 8 | 13511 |
| 52 | I | S | P | N | M | E | R | G | R | E | R | A | D | T | R | 8 | 13512 |
| 93 | Q | I | S | Y | H | S | S | H | E | P | L | P | L | A | Y | 8 | 13513 |
| 145 | G | Y | G | G | I | L | L | V | N | C | D | R | D | D | P | 8 | 13514 |
| 163 | V | Q | D | N | C | D | Q | H | V | H | C | L | Q | D | L | 8 | 13515 |
| 202 | H | T | S | S | Y | D | A | K | R | A | Q | V | F | H | I | 8 | 13516 |
| 212 | Q | V | F | H | I | C | G | P | E | D | V | C | E | A | Y | 8 | 13517 |
| 224 | E | A | Y | R | H | V | L | G | Q | D | K | V | S | Y | E | 8 | 13518 |
| 230 | L | G | Q | D | K | V | S | Y | E | V | P | R | L | G | H | 8 | 13519 |
| 243 | H | G | D | E | E | R | F | F | V | E | G | L | S | F | P | 8 | 13520 |
| 244 | G | D | E | E | R | F | F | V | E | G | L | S | F | P | D | 8 | 13521 |
| 274 | D | S | N | E | D | F | S | A | S | P | I | F | T | D | T | 8 | 13522 |
| 292 | R | V | A | P | W | I | M | T | P | S | T | L | P | P | L | 8 | 13523 |
| 304 | P | P | L | E | V | Y | V | C | R | V | R | N | N | T | C | 8 | 13524 |
| 321 | D | A | V | A | E | L | A | R | K | A | G | C | K | L | T | 8 | 13525 |
| 325 | E | L | A | R | K | A | G | C | K | L | T | I | C | P | Q | 8 | 13526 |
| 334 | L | T | I | C | P | Q | A | E | N | R | N | D | R | W | I | 8 | 13527 |
| 367 | V | F | D | S | P | R | N | G | E | L | Q | D | F | P | Y | 8 | 13528 |
| 403 | G | L | D | S | F | G | N | L | E | V | S | P | P | V | V | 8 | 13529 |
| 432 | G | N | L | P | G | S | S | G | R | R | V | T | Q | V | V | 8 | 13530 |
| 433 | N | L | P | G | S | S | G | R | R | V | T | Q | V | V | R | 8 | 13531 |
| 436 | G | S | S | G | R | R | V | T | Q | V | V | R | D | F | L | 8 | 13532 |
| 511 | A | L | L | F | Q | G | V | V | D | D | E | Q | V | K | T | 8 | 13533 |
| 531 | V | L | S | N | K | D | L | I | N | Y | N | K | F | V | Q | 8 | 13534 |
| 533 | S | N | K | D | L | I | N | Y | N | K | F | V | Q | S | C | 8 | 13535 |
| 549 | D | W | N | R | E | V | L | K | R | E | L | G | L | A | E | 8 | 13536 |
| 555 | L | K | R | E | L | G | L | A | E | C | D | I | I | D | I | 8 | 13537 |
| 561 | L | A | E | C | D | I | I | D | I | P | Q | L | F | K | T | 8 | 13538 |
| 576 | E | R | K | K | A | T | A | F | F | P | D | L | V | N | M | 8 | 13539 |
| 606 | I | I | N | G | C | C | C | L | E | E | K | V | R | S | L | 8 | 13540 |
| 50 | I | Y | I | S | P | N | M | E | R | G | R | E | R | A | D | 7 | 13541 |
| 61 | E | R | A | D | T | R | W | R | F | D | A | T | L | E | | 7 | 13542 |
| 118 | S | L | D | C | D | L | N | C | E | G | R | Q | D | R | N | 7 | 13543 |
| 121 | C | D | L | N | C | E | G | R | Q | D | R | N | F | V | D | 7 | 13544 |
| 123 | L | N | C | E | G | R | Q | D | R | N | F | V | D | K | R | 7 | 13545 |
| 204 | S | S | Y | D | A | K | R | A | Q | V | F | H | I | C | G | 7 | 13546 |
| 216 | I | C | G | P | E | D | V | C | E | A | Y | R | H | V | L | 7 | 13547 |
| 240 | P | R | L | H | G | D | E | E | R | F | F | V | E | G | L | 7 | 13548 |
| 335 | T | I | C | P | Q | A | E | N | R | N | D | R | W | I | Q | 7 | 13549 |
| 336 | I | C | P | Q | A | E | N | R | N | D | R | W | I | Q | D | 7 | 13550 |
| 369 | D | S | P | R | N | G | E | L | Q | D | F | P | Y | K | R | 7 | 13551 |
| 391 | Y | V | T | R | E | P | R | D | R | S | V | S | G | L | D | 7 | 13552 |
| 411 | E | V | S | P | P | V | V | A | N | G | K | E | Y | P | L | 7 | 13553 |
| 445 | V | V | R | D | F | L | H | A | Q | K | V | Q | P | P | V | 7 | 13554 |
| 490 | L | A | S | P | G | A | C | F | K | L | F | Q | E | K | Q | 7 | 13555 |
| 493 | P | G | A | C | F | K | L | F | Q | E | K | Q | K | C | G | 7 | 13556 |
| 507 | G | H | G | R | A | L | L | F | Q | G | V | V | D | D | E | 7 | 13557 |
| 516 | G | V | V | D | D | E | Q | V | K | T | I | S | I | N | Q | 7 | 13558 |
| 607 | I | N | G | C | C | C | L | E | E | K | V | R | S | L | L | 7 | 13559 |
| 128 | R | Q | D | R | N | F | V | D | K | R | Q | W | V | W | G | 6 | 13560 |
| 158 | D | P | S | C | D | V | Q | D | N | C | D | Q | H | V | H | 6 | 13561 |
| 161 | C | D | V | Q | D | N | C | D | Q | H | V | H | C | L | Q | 6 | 13562 |
| 338 | P | Q | A | E | N | R | N | D | R | W | I | Q | D | E | M | 6 | 13563 |
| 341 | E | N | R | N | D | R | W | I | Q | D | E | M | E | L | G | 6 | 13564 |
| 387 | P | D | F | G | Y | V | T | R | E | P | R | D | R | S | V | 6 | 13565 |
| 448 | D | F | L | H | A | Q | K | V | Q | P | P | V | E | L | F | 6 | 13566 |
| 537 | L | I | N | Y | N | K | F | V | Q | S | C | I | D | W | N | 6 | 13567 |
| 645 | H | C | G | T | N | V | C | R | K | P | F | S | F | K | W | 6 | 13568 |
| 650 | V | C | R | K | P | F | S | F | K | W | W | N | M | V | P | 6 | 13569 |
| 7 | V | R | V | S | L | E | H | P | T | S | A | V | C | V | A | 5 | 13570 |
| 408 | G | N | L | E | V | S | P | P | V | A | N | G | K | E | | 5 | 13571 |
| 424 | P | L | G | R | I | L | I | G | G | N | L | P | G | S | S | 5 | 13572 |
| 616 | K | V | R | S | L | L | E | P | L | G | L | H | C | T | F | 5 | 13573 |
| 11 | L | E | H | P | T | S | A | V | C | V | A | G | V | E | T | 4 | 13574 |
| 70 | F | D | A | T | L | E | I | I | V | V | M | N | S | P | S | 4 | 13575 |
| 199 | L | V | L | H | T | S | S | Y | D | A | K | R | A | Q | V | 4 | 13576 |
| 293 | V | A | P | W | I | M | T | P | S | T | L | P | P | L | E | 4 | 13577 |
| 330 | A | G | C | K | L | T | I | C | P | Q | A | E | N | R | N | 4 | 13578 |
| 395 | E | P | R | D | R | S | V | S | G | L | D | S | F | G | N | 4 | 13579 |
| 400 | S | V | S | G | L | D | S | F | G | N | L | E | V | S | P | 4 | 13580 |
| 406 | S | F | G | N | L | E | V | S | P | P | V | V | A | N | G | 4 | 13581 |
| 430 | I | G | G | N | L | P | G | S | S | G | R | R | V | T | Q | 4 | 13582 |
| 457 | P | P | V | E | L | F | V | D | W | L | A | V | G | H | V | 4 | 13583 |
| 462 | F | V | D | W | L | A | V | G | H | V | D | E | F | L | S | 4 | 13584 |
| 508 | H | G | R | A | L | L | F | Q | G | V | V | D | D | E | Q | 4 | 13585 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 553 | E | V | L | K | R | E | L | G | L | A | E | C | D | I | I | 4 | 13586 |
| 583 | F | F | P | D | L | V | N | M | L | V | L | G | K | H | L | 4 | 13587 |
| 5 | R | I | V | R | V | S | L | E | H | P | T | S | A | V | C | 3 | 13588 |
| 9 | V | S | L | E | H | P | T | S | A | V | C | V | A | G | V | 3 | 13589 |
| 46 | P | G | V | D | I | Y | I | S | P | N | M | E | R | G | R | 3 | 13590 |
| 69 | R | F | D | A | T | L | E | I | I | V | V | M | N | S | P | 3 | 13591 |
| 78 | V | V | M | N | S | P | S | N | D | L | N | D | S | H | V | 3 | 13592 |
| 97 | H | S | S | H | E | P | L | P | L | A | Y | A | V | L | Y | 3 | 13593 |
| 98 | S | S | H | E | P | L | P | L | A | Y | A | V | L | Y | L | 3 | 13594 |
| 105 | L | A | Y | A | V | L | Y | L | T | C | V | D | I | S | L | 3 | 13595 |
| 113 | T | C | V | D | I | S | L | D | C | D | L | N | C | E | G | 3 | 13596 |
| 115 | V | D | I | S | L | D | C | D | L | N | C | E | G | R | Q | 3 | 13597 |
| 119 | L | D | C | D | L | N | C | E | G | R | Q | D | R | N | F | 3 | 13598 |
| 141 | W | G | P | S | G | Y | G | G | I | L | L | V | N | C | D | 3 | 13599 |
| 143 | P | S | G | Y | G | G | I | L | L | V | N | C | D | R | D | 3 | 13600 |
| 175 | Q | D | L | E | D | M | S | V | M | V | L | R | T | Q | G | 3 | 13601 |
| 194 | F | D | D | H | K | L | V | L | H | T | S | S | Y | D | A | 3 | 13602 |
| 223 | C | E | A | Y | R | H | V | L | G | Q | D | K | V | S | Y | 3 | 13603 |
| 235 | V | S | Y | E | V | P | R | L | H | G | D | E | E | R | F | 3 | 13604 |
| 237 | Y | E | V | P | R | L | H | G | D | E | E | R | F | F | V | 3 | 13605 |
| 296 | W | I | M | T | P | S | T | L | P | P | L | E | V | Y | V | 3 | 13606 |
| 302 | T | L | P | P | L | E | V | Y | V | C | R | V | R | N | N | 3 | 13607 |
| 319 | F | V | D | A | V | A | E | L | A | R | K | A | G | C | K | 3 | 13608 |
| 322 | A | V | A | E | L | A | R | K | A | G | C | K | L | T | I | 3 | 13609 |
| 324 | A | E | L | A | R | K | A | G | C | K | L | T | I | C | P | 3 | 13610 |
| 348 | I | Q | D | E | M | E | L | G | Y | V | Q | A | P | H | K | 3 | 13611 |
| 355 | G | Y | V | Q | A | P | H | K | T | L | P | V | V | F | D | 3 | 13612 |
| 358 | Q | A | P | H | K | T | L | P | V | V | F | D | S | P | R | 3 | 13613 |
| 360 | P | H | K | T | L | P | V | V | F | D | S | P | R | N | G | 3 | 13614 |
| 397 | R | D | R | S | V | S | G | L | D | S | F | G | N | L | E | 3 | 13615 |
| 417 | V | A | N | G | K | E | Y | P | L | G | R | I | L | I | G | 3 | 13616 |
| 480 | A | P | D | G | K | G | F | R | M | L | L | A | S | P | G | 3 | 13617 |
| 506 | C | G | H | G | R | A | L | L | F | Q | G | V | V | D | D | 3 | 13618 |
| 546 | S | C | I | D | W | N | R | E | V | L | K | R | E | L | G | 3 | 13619 |
| 565 | D | I | I | D | I | P | Q | L | F | K | T | E | R | K | K | 3 | 13620 |
| 591 | L | V | L | G | K | H | L | G | I | P | K | P | F | G | P | 3 | 13621 |
| 595 | K | H | L | G | I | P | K | P | F | G | P | I | I | N | G | 3 | 13622 |
| 597 | L | G | I | P | K | P | F | G | P | I | I | N | G | C | C | 3 | 13623 |
| 612 | C | L | E | E | K | V | R | S | L | L | E | P | L | G | L | 3 | 13624 |
| 640 | L | H | G | E | V | H | C | G | T | N | V | C | R | K | P | 3 | 13625 |
| 649 | N | V | C | R | K | P | F | S | F | K | W | W | N | M | V | 3 | 13626 |
| 1 | M | S | L | Q | R | I | V | R | V | S | L | E | H | P | T | 2 | 13627 |
| 2 | S | L | Q | R | I | V | R | V | S | L | E | H | P | T | S | 2 | 13628 |
| 14 | P | T | S | A | V | C | V | A | G | V | E | T | L | V | D | 2 | 13629 |
| 21 | A | G | V | E | T | L | V | D | I | Y | G | S | V | P | E | 2 | 13630 |
| 25 | T | L | V | D | I | Y | G | S | V | P | E | G | T | E | M | 2 | 13631 |
| 34 | P | E | G | T | E | M | F | E | V | Y | G | T | P | G | V | 2 | 13632 |
| 41 | E | V | Y | G | T | P | G | V | D | I | Y | I | S | P | N | 2 | 13633 |
| 48 | V | D | I | Y | I | S | P | N | M | E | R | G | R | E | R | 2 | 13634 |
| 56 | M | E | R | G | R | E | R | A | D | T | R | R | W | R | F | 2 | 13635 |
| 62 | R | A | D | T | R | R | W | R | F | D | A | T | L | E | I | 2 | 13636 |
| 72 | A | T | L | E | I | I | V | V | M | N | S | P | S | N | D | 2 | 13637 |
| 79 | V | M | N | S | P | S | N | D | L | N | D | S | H | V | Q | 2 | 13638 |
| 88 | N | D | S | H | V | Q | I | S | Y | H | S | S | H | E | P | 2 | 13639 |
| 90 | S | H | V | Q | I | S | Y | H | S | S | H | E | P | L | P | 2 | 13640 |
| 95 | S | Y | H | S | S | H | E | P | L | P | L | A | Y | A | V | 2 | 13641 |
| 103 | L | P | L | A | Y | A | V | L | Y | L | T | C | V | D | I | 2 | 13642 |
| 111 | Y | L | T | C | V | D | I | S | L | D | C | D | L | N | C | 2 | 13643 |
| 136 | K | R | Q | W | V | W | G | P | S | G | Y | G | G | I | L | 2 | 13644 |
| 138 | Q | W | V | W | G | P | S | G | Y | G | G | I | L | L | V | 2 | 13645 |
| 144 | S | G | Y | G | G | I | L | L | V | N | C | D | R | D | D | 2 | 13646 |
| 154 | C | D | R | D | D | P | S | C | D | V | Q | D | N | C | D | 2 | 13647 |
| 155 | D | R | D | D | P | S | C | D | V | Q | D | N | C | D | Q | 2 | 13648 |
| 176 | D | L | E | D | M | S | V | M | V | L | R | T | Q | G | P | 2 | 13649 |
| 192 | A | L | F | D | D | H | K | L | V | L | H | T | S | S | Y | 2 | 13650 |
| 220 | E | D | V | C | E | A | Y | R | H | V | L | G | Q | D | K | 2 | 13651 |
| 225 | A | Y | R | H | V | L | G | Q | D | K | V | S | Y | E | V | 2 | 13652 |
| 242 | L | H | G | D | E | E | R | F | F | V | E | G | L | S | F | 2 | 13653 |
| 249 | F | F | V | E | G | L | S | F | P | D | A | G | F | T | G | 2 | 13654 |
| 259 | A | G | F | T | G | L | I | S | F | H | V | T | L | L | D | 2 | 13655 |
| 265 | I | S | F | H | V | T | L | L | D | D | S | N | E | D | F | 2 | 13656 |
| 270 | T | L | L | D | D | S | N | E | D | F | S | A | S | P | I | 2 | 13657 |
| 275 | S | N | E | D | F | S | A | S | P | I | F | T | D | T | V | 2 | 13658 |
| 285 | F | T | D | T | V | V | F | R | V | A | P | W | I | M | T | 2 | 13659 |
| 297 | I | M | T | P | S | T | L | P | P | L | E | V | Y | V | C | 2 | 13660 |
| 301 | S | T | L | P | P | L | E | V | Y | V | C | R | V | R | N | 2 | 13661 |
| 313 | V | R | N | N | T | C | F | V | D | A | V | A | E | L | A | 2 | 13662 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 314 | R | N | N | T | C | F | V | D | A | V | A | E | L | A | R | 2 | 13663 |
| 318 | C | F | V | D | A | V | A | E | L | A | R | K | A | G | C | 2 | 13664 |
| 329 | K | A | G | C | K | L | T | I | C | P | Q | A | E | N | R | 2 | 13665 |
| 332 | C | K | L | T | I | C | P | Q | A | E | N | R | N | D | R | 2 | 13666 |
| 346 | R | W | I | Q | D | E | M | E | L | G | Y | V | Q | A | P | 2 | 13667 |
| 347 | W | I | Q | D | E | M | E | L | G | Y | V | Q | A | P | H | 2 | 13668 |
| 359 | A | P | H | K | T | L | P | V | V | F | D | S | P | R | N | 2 | 13669 |
| 366 | V | V | F | D | S | P | R | N | G | E | L | Q | D | F | P | 2 | 13670 |
| 379 | F | P | Y | K | R | I | L | G | P | D | F | G | Y | V | T | 2 | 13671 |
| 383 | R | I | L | G | P | D | F | G | Y | V | T | R | E | P | R | 2 | 13672 |
| 388 | D | F | G | Y | V | T | R | E | P | R | D | R | S | V | S | 2 | 13673 |
| 390 | G | Y | V | T | R | E | P | R | D | R | S | V | S | G | L | 2 | 13674 |
| 410 | L | E | V | S | P | P | V | V | A | N | G | K | E | Y | P | 2 | 13675 |
| 415 | P | V | V | A | N | G | K | E | Y | P | L | G | R | I | L | 2 | 13676 |
| 420 | G | K | E | Y | P | L | G | R | I | L | I | G | G | N | L | 2 | 13677 |
| 421 | K | E | Y | P | L | G | R | I | L | I | G | G | N | L | P | 2 | 13678 |
| 429 | L | I | G | G | N | L | P | G | S | S | G | R | R | V | T | 2 | 13679 |
| 437 | S | S | G | R | R | V | T | Q | V | V | R | D | F | L | H | 2 | 13680 |
| 441 | R | V | T | Q | V | V | R | D | F | L | H | A | Q | K | V | 2 | 13681 |
| 444 | Q | V | V | R | D | F | L | H | A | Q | K | V | Q | P | P | 2 | 13682 |
| 453 | Q | K | V | Q | P | P | V | E | L | F | V | D | W | L | A | 2 | 13683 |
| 454 | K | V | Q | P | P | V | E | L | F | V | D | W | L | A | V | 2 | 13684 |
| 469 | G | H | V | D | E | F | L | S | F | V | P | A | P | D | G | 2 | 13685 |
| 470 | H | V | D | E | F | L | S | F | V | P | A | P | D | G | K | 2 | 13686 |
| 481 | P | D | G | K | G | F | R | M | L | L | A | S | P | G | A | 2 | 13687 |
| 482 | D | G | K | G | F | R | M | L | L | A | S | P | G | A | C | 2 | 13688 |
| 492 | S | P | G | A | C | F | K | L | F | Q | E | K | Q | K | C | 2 | 13689 |
| 519 | D | D | E | Q | V | K | T | I | S | I | N | Q | V | L | S | 2 | 13690 |
| 524 | K | T | I | S | I | N | Q | V | L | S | N | K | D | L | I | 2 | 13691 |
| 554 | V | L | K | R | E | L | G | L | A | E | C | D | I | I | D | 2 | 13692 |
| 557 | R | E | L | G | L | A | E | C | D | I | I | D | I | P | Q | 2 | 13693 |
| 567 | I | D | I | P | Q | L | F | K | T | E | R | K | K | A | T | 2 | 13694 |
| 577 | R | K | K | A | T | A | F | F | P | D | L | V | N | M | L | 2 | 13695 |
| 578 | K | K | A | T | A | F | F | P | D | L | V | N | M | L | V | 2 | 13696 |
| 579 | K | A | T | A | F | F | P | D | L | V | N | M | L | V | L | 2 | 13697 |
| 598 | G | I | P | K | P | F | G | P | I | I | N | G | C | C | C | 2 | 13698 |
| 611 | C | C | L | E | E | K | V | R | S | L | L | E | P | L | G | 2 | 13699 |
| 620 | L | L | E | P | L | G | L | H | C | T | F | I | D | D | F | 2 | 13700 |
| 622 | E | P | L | G | L | H | C | T | F | I | D | D | F | T | P | 2 | 13701 |
| 648 | T | N | V | C | R | K | P | F | S | F | K | W | W | N | M | 2 | 13702 |
| 12 | E | H | P | T | S | A | V | C | V | A | G | V | E | T | L | 1 | 13703 |
| 18 | V | C | V | A | G | V | E | T | L | V | D | I | Y | G | S | 1 | 13704 |
| 28 | D | I | Y | G | S | V | P | E | G | T | E | M | F | E | V | 1 | 13705 |
| 31 | G | S | V | P | E | G | T | E | M | F | E | V | Y | G | T | 1 | 13706 |
| 38 | E | M | F | E | V | Y | G | T | P | G | V | D | I | Y | I | 1 | 13707 |
| 44 | G | T | P | G | V | D | I | Y | I | S | P | N | M | E | R | 1 | 13708 |
| 51 | Y | I | S | P | N | M | E | R | G | R | E | R | A | D | T | 1 | 13709 |
| 64 | D | T | R | R | W | R | F | D | A | T | L | E | I | I | V | 1 | 13710 |
| 68 | W | R | F | D | A | T | L | E | I | I | V | V | M | N | S | 1 | 13711 |
| 82 | S | P | S | N | D | L | N | D | S | H | V | Q | I | S | Y | 1 | 13712 |
| 125 | C | E | G | R | Q | D | R | N | F | V | D | K | R | Q | W | 1 | 13713 |
| 126 | E | G | R | Q | D | R | N | F | V | D | K | R | Q | W | V | 1 | 13714 |
| 127 | G | R | Q | D | R | N | F | V | D | K | R | Q | W | V | W | 1 | 13715 |
| 132 | N | F | V | D | K | R | Q | W | V | W | G | P | S | G | Y | 1 | 13716 |
| 133 | F | V | D | K | R | Q | W | V | W | G | P | S | G | Y | G | 1 | 13717 |
| 142 | G | P | S | G | Y | G | I | L | L | V | N | C | D | R | 1 | 13718 |
| 153 | N | C | D | R | D | D | P | S | C | D | V | Q | D | N | C | 1 | 13719 |
| 157 | D | D | P | S | C | D | V | Q | D | N | C | D | Q | H | V | 1 | 13720 |
| 164 | Q | D | N | C | D | Q | H | V | H | C | L | Q | D | L | E | 1 | 13721 |
| 165 | D | N | C | D | Q | H | V | H | C | L | Q | D | L | E | D | 1 | 13722 |
| 169 | Q | H | V | H | C | L | Q | D | L | E | D | M | S | V | M | 1 | 13723 |
| 172 | H | C | L | Q | D | L | E | D | M | S | V | M | V | L | R | 1 | 13724 |
| 184 | V | L | R | T | Q | G | P | A | A | L | F | D | D | H | K | 1 | 13725 |
| 185 | L | R | T | Q | G | P | A | A | L | F | D | D | H | K | L | 1 | 13726 |
| 186 | R | T | Q | G | P | A | A | L | F | D | D | H | K | L | V | 1 | 13727 |
| 200 | V | L | H | T | S | S | Y | D | A | K | R | A | Q | V | F | 1 | 13728 |
| 205 | S | Y | D | A | K | R | A | Q | V | F | H | I | C | G | P | 1 | 13729 |
| 206 | Y | D | A | K | R | A | Q | V | F | H | I | C | G | P | E | 1 | 13730 |
| 209 | K | R | A | Q | V | F | H | I | C | G | P | E | D | V | C | 1 | 13731 |
| 214 | F | H | I | C | G | P | E | D | V | C | E | A | Y | R | H | 1 | 13732 |
| 217 | C | G | P | E | D | V | C | E | A | Y | R | H | V | L | G | 1 | 13733 |
| 218 | G | P | E | D | V | C | E | A | Y | R | H | V | L | G | Q | 1 | 13734 |
| 221 | D | V | C | E | A | Y | R | H | V | L | G | Q | D | K | V | 1 | 13735 |
| 229 | V | L | G | Q | D | K | V | S | Y | E | V | P | R | L | H | 1 | 13736 |
| 241 | R | L | H | G | D | E | R | F | V | E | G | L | S | 1 | 13737 |
| 254 | L | S | F | P | D | A | G | F | T | G | L | I | S | F | H | 1 | 13738 |
| 255 | S | F | P | D | A | G | F | T | G | L | I | S | F | H | V | 1 | 13739 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 257 | P | D | A | G | F | T | G | L | I | S | F | H | V | T | L | 1 | 13740 |
| 263 | G | L | I | S | F | H | V | T | L | L | D | D | S | N | E | 1 | 13741 |
| 271 | L | L | D | D | S | N | E | D | F | S | A | S | P | I | F | 1 | 13742 |
| 273 | D | D | S | N | E | D | F | S | A | S | P | I | F | T | D | 1 | 13743 |
| 277 | E | D | F | S | A | S | P | I | F | T | D | T | V | V | F | 1 | 13744 |
| 278 | D | F | S | A | S | P | I | F | T | D | T | V | F | R | | 1 | 13745 |
| 289 | V | V | F | R | V | A | P | W | I | M | T | P | S | T | L | 1 | 13746 |
| 309 | Y | V | C | R | V | R | N | N | T | C | F | V | D | A | V | 1 | 13747 |
| 311 | C | R | V | R | N | N | T | C | F | V | D | A | V | A | E | 1 | 13748 |
| 312 | R | V | R | N | N | T | C | F | V | D | A | V | A | E | L | 1 | 13749 |
| 326 | L | A | R | K | A | G | C | K | L | T | I | C | P | Q | A | 1 | 13750 |
| 327 | A | R | K | A | G | C | K | L | T | I | C | P | Q | A | E | 1 | 13751 |
| 340 | A | E | N | R | N | D | R | W | I | Q | D | E | M | E | L | 1 | 13752 |
| 342 | N | R | N | D | R | W | I | Q | D | E | M | E | L | G | Y | 1 | 13753 |
| 352 | M | E | L | G | Y | V | Q | A | P | H | K | T | L | P | V | 1 | 13754 |
| 362 | K | T | L | P | V | V | F | D | S | P | R | N | G | E | L | 1 | 13755 |
| 371 | P | R | N | G | E | L | Q | D | F | P | Y | K | R | I | L | 1 | 13756 |
| 394 | R | E | P | R | D | R | S | V | S | G | L | D | S | F | G | 1 | 13757 |
| 405 | D | S | F | G | N | L | E | V | S | P | P | V | V | A | N | 1 | 13758 |
| 416 | V | V | A | N | G | K | E | Y | P | L | G | R | I | L | I | 1 | 13759 |
| 428 | I | L | I | G | G | N | L | P | G | S | S | G | R | R | V | 1 | 13760 |
| 435 | P | G | S | S | G | R | R | V | T | Q | V | V | R | D | F | 1 | 13761 |
| 440 | R | R | V | T | Q | V | V | R | D | F | L | H | A | Q | K | 1 | 13762 |
| 461 | L | F | V | D | W | L | A | V | G | H | V | D | E | F | L | 1 | 13763 |
| 467 | A | V | G | H | V | D | E | F | L | S | F | V | P | A | P | 1 | 13764 |
| 477 | F | V | P | A | P | D | G | K | G | F | R | M | L | L | A | 1 | 13765 |
| 484 | K | G | F | R | M | L | L | A | S | P | G | A | C | F | K | 1 | 13766 |
| 491 | A | S | P | G | A | C | F | K | L | F | Q | E | K | Q | K | 1 | 13767 |
| 498 | K | L | F | Q | E | K | Q | K | C | G | H | G | R | A | L | 1 | 13768 |
| 499 | L | F | Q | E | K | Q | K | C | G | H | G | R | A | L | L | 1 | 13769 |
| 500 | F | Q | E | K | Q | K | C | G | H | G | R | A | L | L | F | 1 | 13770 |
| 504 | Q | K | C | G | H | G | R | A | L | L | F | Q | G | V | V | 1 | 13771 |
| 505 | K | C | G | H | G | R | A | L | L | F | Q | G | V | V | D | 1 | 13772 |
| 517 | V | V | D | D | E | Q | V | K | T | I | S | I | N | Q | V | 1 | 13773 |
| 536 | D | L | I | N | Y | N | K | F | V | Q | S | C | I | D | W | 1 | 13774 |
| 538 | I | N | Y | N | K | F | V | Q | S | C | I | D | W | N | R | 1 | 13775 |
| 539 | N | Y | N | K | F | V | Q | S | C | I | D | W | N | R | E | 1 | 13776 |
| 542 | K | F | V | Q | S | C | I | D | W | N | R | E | V | L | K | 1 | 13777 |
| 574 | K | T | E | R | K | K | A | T | A | F | F | P | D | L | V | 1 | 13778 |
| 575 | T | E | R | K | K | A | T | A | F | F | P | D | L | V | N | 1 | 13779 |
| 599 | I | P | K | P | F | G | P | I | I | N | G | C | C | C | L | 1 | 13780 |
| 625 | G | L | H | C | T | F | I | D | D | F | T | P | Y | H | M | 1 | 13781 |
| 630 | F | I | D | D | F | T | P | Y | H | M | L | H | G | E | V | 1 | 13782 |
| 633 | D | F | T | P | Y | H | M | L | H | G | E | V | H | C | G | 1 | 13783 |
| 634 | F | T | P | Y | H | M | L | H | G | E | V | H | C | G | T | 1 | 13784 |
| 638 | H | M | L | H | G | E | V | H | C | G | T | N | V | C | R | 1 | 13785 |
| 639 | M | L | H | G | E | V | H | C | G | T | N | V | C | R | K | 1 | 13786 |
| 643 | E | V | H | C | G | T | N | V | C | R | K | P | F | S | F | 1 | 13787 |

184P1E2 v.2: HLA Peptide Scoring Results DRB1 0301 15-mers SYFPEITHI

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 6 | P | W | I | M | T | P | S | T | L | A | P | L | E | V | Y | 21 | 13788 |
| 5 | A | P | W | I | M | T | P | S | T | L | A | P | L | E | V | 13 | 13789 |
| 11 | P | S | T | L | A | P | L | E | V | Y | V | C | R | V | R | 12 | 13790 |
| 1 | V | F | R | V | A | P | W | I | M | T | P | S | T | L | A | 11 | 13791 |
| 9 | M | T | P | S | T | L | A | P | L | E | V | Y | V | C | R | 11 | 13792 |
| 10 | T | P | S | T | L | A | P | L | E | V | Y | V | C | R | V | 10 | 13793 |
| 14 | L | A | P | L | E | V | Y | V | C | R | V | R | N | N | T | 10 | 13794 |
| 3 | R | V | A | P | W | I | M | T | P | S | T | L | A | P | L | 8 | 13795 |
| 15 | A | P | L | E | V | Y | V | C | R | V | R | N | N | T | C | 8 | 13796 |
| 4 | V | A | P | W | I | M | T | P | S | T | L | A | P | L | E | 4 | 13797 |
| 7 | W | I | M | T | P | S | T | L | A | P | L | E | V | Y | V | 3 | 13798 |
| 13 | T | L | A | P | L | E | V | Y | V | C | R | V | R | N | N | 3 | 13799 |
| 12 | S | T | L | A | P | L | E | V | Y | V | C | R | V | R | N | 2 | 13800 |
| 8 | I | M | T | P | S | T | L | A | P | L | E | V | Y | V | C | 1 | 13801 |

184P1E2 v.3: HLA Peptide Scoring Results DRB1 0301 15-mers SYFPEITHI

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| sq | L | A | V | G | H | V | D | E | F | L | S | F | V | P | V | 20 | 13802 |
| 11 | S | F | V | P | V | P | D | G | K | G | F | R | M | L | L | 19 | 13803 |
| 10 | L | S | F | V | P | V | P | D | G | K | G | F | R | M | L | 18 | 13804 |
| 14 | P | V | P | D | G | K | G | F | R | M | L | L | A | S | P | 15 | 13805 |
| 3 | V | G | H | V | D | E | F | L | S | F | V | P | V | P | D | 12 | 13806 |
| 6 | V | D | E | F | L | S | F | V | P | V | P | D | G | K | G | 12 | 13807 |
| 9 | F | L | S | F | V | P | V | P | D | G | K | G | F | R | M | 12 | 13808 |
| 7 | D | E | F | L | S | F | V | P | V | P | D | G | K | G | F | 11 | 13809 |
| 12 | F | V | P | V | P | D | G | K | G | F | R | M | L | L | A | 11 | 13810 |
| 13 | V | P | V | P | D | G | K | G | F | R | M | L | L | A | S | 9 | 13811 |
| 15 | V | P | D | G | K | G | F | R | M | L | L | A | S | P | G | 3 | 13812 |

TABLE XLIX-continued

| Pos | 1 | 2 | 3 | 4 | 5 | 6 | 7 | 8 | 9 | 0 | 1 | 2 | 3 | 4 | 5 | score | SEQ.ID NO. |
|---|---|---|---|---|---|---|---|---|---|---|---|---|---|---|---|---|---|
| 4 | G | H | V | D | E | F | L | S | F | V | P | V | P | D | G | 2 | 13813 |
| 2 | A | V | G | H | V | D | E | F | L | S | F | V | P | V | P | 1 | 13814 |
| 5 | H | V | D | E | F | L | S | F | V | P | V | P | D | G | K | 1 | 13815' |

TABLE L

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 184P1E2 v.1: HLA Peptide Scoring Results DRB1 0401 15-mers SYFPEITHI ||||||||||||||||||
| 65 | T | R | R | W | R | F | D | A | T | L | E | I | I | V | V | 28 | 13816 |
| 258 | D | A | G | F | T | G | L | I | S | F | H | V | T | L | L | 28 | 13817 |
| 353 | E | L | G | Y | V | Q | A | P | H | K | T | L | P | V | V | 28 | 13818 |
| 537 | L | I | N | Y | N | K | F | V | Q | S | C | I | D | W | N | 28 | 13819 |
| 581 | T | A | F | F | P | D | L | V | N | M | L | V | L | G | K | 28 | 13820 |
| 73 | T | L | E | I | I | V | V | M | N | S | P | S | N | D | L | 26 | 13821 |
| 219 | P | E | D | V | C | E | A | Y | R | H | V | L | G | Q | D | 26 | 13822 |
| 389 | F | G | Y | V | T | R | E | P | R | D | R | S | V | S | G | 26 | 13823 |
| 398 | D | R | S | V | S | G | L | D | S | F | G | N | L | E | V | 26 | 13824 |
| 401 | V | S | G | L | D | S | F | G | N | L | E | V | S | P | P | 26 | 13825 |
| 439 | G | R | R | V | T | Q | V | V | R | D | F | L | H | A | Q | 26 | 13826 |
| 443 | T | Q | V | V | R | D | F | L | H | A | Q | K | V | Q | P | 26 | 13827 |
| 514 | F | Q | G | V | V | D | D | E | Q | V | K | T | I | S | I | 26 | 13828 |
| 563 | E | C | D | I | I | D | I | P | Q | L | F | K | T | E | R | 26 | 13829 |
| 637 | Y | H | M | L | H | G | E | V | H | C | G | T | N | V | C | 26 | 13830 |
| 37 | T | E | M | F | E | V | Y | G | T | P | G | V | D | I | Y | 22 | 13831 |
| 104 | P | L | A | Y | A | V | L | Y | L | T | C | V | D | I | S | 22 | 13832 |
| 223 | C | E | A | Y | R | H | V | L | G | Q | D | K | V | S | Y | 22 | 13833 |
| 253 | G | L | S | F | P | D | A | G | F | T | G | L | I | S | F | 22 | 13834 |
| 288 | T | V | V | F | R | V | A | P | W | I | M | T | P | S | T | 22 | 13835 |
| 316 | N | T | C | F | V | D | A | V | A | E | L | A | R | K | A | 22 | 13836 |
| 365 | P | V | V | F | D | S | P | R | N | G | E | L | Q | D | F | 22 | 13837 |
| 386 | G | P | D | F | G | Y | V | T | R | E | P | R | D | R | S | 22 | 13838 |
| 462 | F | V | D | W | L | A | V | G | H | V | D | E | F | L | S | 22 | 13839 |
| 494 | G | A | C | F | K | L | F | Q | E | K | Q | K | C | G | H | 22 | 13840 |
| 511 | A | L | L | F | Q | G | V | V | D | D | E | Q | V | K | T | 22 | 13841 |
| 570 | P | Q | L | F | K | T | E | R | K | K | A | T | A | F | F | 22 | 13842 |
| 580 | A | T | A | F | F | P | D | L | V | N | M | L | V | L | G | 22 | 13843 |
| 600 | P | K | P | F | G | P | I | I | N | G | C | C | C | L | E | 22 | 13844 |
| 627 | H | C | T | F | I | D | D | F | T | P | Y | H | M | L | H | 22 | 13845 |
| 6 | I | V | R | V | S | L | E | H | P | T | S | A | V | C | V | 20 | 13846 |
| 15 | T | S | A | V | C | V | A | G | V | E | T | L | V | D | I | 20 | 13847 |
| 17 | A | V | C | V | A | G | V | E | T | L | V | D | I | Y | G | 20 | 13848 |
| 45 | T | P | G | V | D | I | Y | I | S | P | N | M | E | R | G | 20 | 13849 |
| 71 | D | A | T | L | E | I | I | V | V | M | N | S | P | S | N | 20 | 13850 |
| 74 | L | E | I | I | V | V | M | N | S | P | S | N | D | L | N | 20 | 13851 |
| 76 | I | I | V | V | M | N | S | P | S | N | D | L | N | D | S | 20 | 13852 |
| 77 | I | V | V | M | N | S | P | S | N | D | L | N | D | S | H | 20 | 13853 |
| 102 | P | L | P | L | A | Y | A | V | L | Y | L | T | C | V | D | 20 | 13854 |
| 106 | A | Y | A | V | L | Y | L | T | C | V | D | I | S | L | D | 20 | 13855 |
| 116 | D | I | S | L | D | C | D | L | N | C | E | G | R | Q | D | 20 | 13856 |
| 120 | D | C | D | L | N | C | E | G | R | Q | D | R | N | F | V | 20 | 13857 |
| 149 | I | L | L | V | N | C | D | R | D | D | P | S | C | D | V | 20 | 13858 |
| 171 | V | H | C | L | Q | D | L | E | D | M | S | V | M | V | L | 20 | 13859 |
| 179 | D | M | S | V | M | V | L | R | T | Q | G | P | A | A | L | 20 | 13860 |
| 190 | P | A | A | L | F | D | D | H | K | L | V | L | H | T | S | 20 | 13861 |
| 197 | H | K | L | V | L | H | T | S | S | Y | D | A | K | R | A | 20 | 13862 |
| 248 | R | F | F | V | E | G | L | S | F | P | D | A | G | F | T | 20 | 13863 |
| 261 | F | T | G | L | I | S | F | H | V | T | L | L | D | D | S | 20 | 13864 |
| 268 | H | V | T | L | L | D | D | S | N | E | D | F | S | A | S | 20 | 13865 |
| 287 | D | T | V | V | F | R | V | A | P | W | I | M | T | P | S | 20 | 13866 |
| 307 | E | V | Y | V | C | R | V | R | N | N | T | C | F | V | D | 20 | 13867 |
| 320 | V | D | A | V | A | E | L | A | R | K | A | G | C | K | L | 20 | 13868 |
| 331 | G | C | K | L | T | I | C | P | Q | A | E | N | R | N | D | 20 | 13869 |
| 351 | E | M | E | L | G | Y | V | V | Q | A | P | H | K | T | L | 20 | 13870 |
| 373 | N | G | E | L | Q | D | F | P | Y | K | R | I | L | G | P | 20 | 13871 |
| 382 | K | R | I | L | G | P | D | F | G | Y | V | T | R | E | P | 20 | 13872 |
| 422 | E | Y | P | L | G | R | I | L | I | G | G | N | L | P | G | 20 | 13873 |
| 442 | V | T | Q | V | V | R | D | F | L | H | A | Q | K | V | Q | 20 | 13874 |
| 456 | Q | P | P | V | E | L | F | V | D | W | L | A | V | G | H | 20 | 13875 |
| 460 | E | L | F | V | D | W | L | A | V | G | H | V | D | E | F | 20 | 13876 |
| 465 | W | L | A | V | G | H | V | D | E | F | L | S | F | V | P | 20 | 13877 |
| 468 | V | G | H | V | D | E | F | L | S | F | V | P | A | P | D | 20 | 13878 |
| 496 | C | F | K | L | F | Q | E | K | Q | K | C | G | H | G | R | 20 | 13879 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 515 | Q | G | V | V | D | D | E | Q | V | K | T | I | S | I | N | 20 | 13880 |
| 520 | D | E | Q | V | K | T | I | S | I | N | Q | V | L | S | N | 20 | 13881 |
| 525 | T | I | S | I | N | Q | V | L | S | N | K | D | L | I | N | 20 | 13882 |
| 556 | K | R | E | L | G | L | A | E | C | D | I | I | D | I | P | 20 | 13883 |
| 569 | I | P | Q | L | F | K | T | E | R | K | K | A | T | A | F | 20 | 13884 |
| 588 | V | N | M | L | V | L | G | K | H | L | G | I | P | K | P | 20 | 13885 |
| 618 | R | S | L | L | E | P | L | G | L | H | C | T | F | I | D | 20 | 13886 |
| 628 | C | T | F | I | D | D | F | T | P | Y | H | M | L | H | G | 20 | 13887 |
| 5 | R | I | V | R | V | S | L | E | H | P | T | S | A | V | C | 18 | 13888 |
| 83 | P | S | N | D | L | N | D | S | H | V | Q | I | S | Y | H | 18 | 13889 |
| 129 | Q | D | R | N | F | V | D | K | R | Q | W | V | W | G | P | 18 | 13890 |
| 152 | V | N | C | D | R | D | D | P | S | C | D | V | Q | D | N | 18 | 13891 |
| 173 | C | L | Q | D | L | E | D | M | S | V | M | V | L | R | T | 18 | 13892 |
| 189 | G | P | A | A | L | F | D | D | H | K | L | V | L | H | T | 18 | 13893 |
| 194 | F | D | D | H | K | L | V | L | H | T | S | S | Y | D | A | 18 | 13894 |
| 202 | H | T | S | S | Y | D | A | K | R | A | Q | V | F | H | I | 18 | 13895 |
| 224 | E | A | Y | R | H | V | L | G | Q | D | K | V | S | Y | E | 18 | 13896 |
| 240 | P | R | L | H | G | D | E | R | F | F | V | E | G | L | 18 | 13897 |
| 278 | D | F | S | A | S | P | I | F | T | D | T | V | V | F | R | 18 | 13898 |
| 291 | F | R | V | A | P | W | I | M | T | P | S | T | L | P | P | 18 | 13899 |
| 304 | P | P | L | E | V | Y | V | C | R | V | R | N | N | T | C | 18 | 13900 |
| 362 | K | T | L | P | V | V | F | D | S | P | R | N | G | E | L | 18 | 13901 |
| 405 | D | S | F | G | N | L | E | V | S | P | P | V | V | A | N | 18 | 13902 |
| 419 | N | G | K | E | Y | P | L | G | R | I | L | I | G | G | N | 18 | 13903 |
| 484 | K | G | F | R | M | L | L | A | S | P | G | A | C | F | K | 18 | 13904 |
| 493 | P | G | A | C | F | K | L | F | Q | E | K | Q | K | C | G | 18 | 13905 |
| 507 | G | H | G | R | A | L | L | F | Q | G | V | V | D | D | E | 18 | 13906 |
| 517 | V | V | D | D | E | Q | V | K | T | I | S | I | N | Q | V | 18 | 13907 |
| 522 | Q | V | K | T | I | S | I | N | Q | V | L | S | N | K | D | 18 | 13908 |
| 526 | I | S | I | N | Q | V | L | S | N | K | D | L | I | N | Y | 18 | 13909 |
| 531 | V | L | S | N | K | D | L | I | N | Y | K | F | V | Q | 18 | 13910 |
| 543 | F | V | Q | S | C | I | D | W | N | R | E | V | L | K | R | 18 | 13911 |
| 567 | I | D | I | P | Q | L | F | K | T | E | R | K | K | A | T | 18 | 13912 |
| 306 | L | E | V | Y | V | C | R | V | R | N | N | T | C | F | V | 17 | 13913 |
| 27 | V | D | I | Y | G | S | V | P | E | G | T | E | M | F | E | 16 | 13914 |
| 67 | R | W | R | F | D | A | T | L | E | I | I | V | V | M | N | 16 | 13915 |
| 108 | A | V | L | Y | L | T | C | V | D | I | S | L | D | C | D | 16 | 13916 |
| 136 | K | R | Q | W | V | W | G | P | S | G | Y | G | G | I | L | 16 | 13917 |
| 138 | Q | W | V | W | G | P | S | G | Y | G | G | I | L | L | V | 16 | 13918 |
| 143 | P | S | G | Y | G | G | I | L | L | V | N | C | D | R | D | 16 | 13919 |
| 211 | A | Q | V | F | H | I | C | G | P | E | D | V | C | E | A | 16 | 13920 |
| 246 | E | E | R | F | F | V | E | G | L | S | F | P | D | A | G | 16 | 13921 |
| 247 | E | R | F | F | V | E | G | L | S | F | P | D | A | G | F | 16 | 13922 |
| 264 | L | I | S | F | H | V | T | L | L | D | D | S | N | E | D | 16 | 13923 |
| 282 | S | P | I | F | T | D | T | V | V | F | R | V | A | P | W | 16 | 13924 |
| 293 | V | A | P | W | I | M | T | P | S | T | L | P | P | L | E | 16 | 13925 |
| 344 | N | D | R | W | I | Q | D | E | M | E | L | G | Y | V | Q | 16 | 13926 |
| 378 | D | F | P | Y | K | R | I | L | G | P | D | F | G | Y | V | 16 | 13927 |
| 404 | L | D | S | F | G | N | L | E | V | S | P | P | V | V | A | 16 | 13928 |
| 446 | V | R | D | F | L | H | A | Q | K | V | Q | P | P | V | E | 16 | 13929 |
| 471 | V | D | E | F | L | S | F | V | P | A | P | D | G | K | G | 16 | 13930 |
| 474 | F | L | S | F | V | P | A | P | D | G | K | G | F | R | M | 16 | 13931 |
| 483 | G | K | G | F | R | M | L | L | A | S | P | G | A | C | F | 16 | 13932 |
| 540 | Y | N | K | F | V | Q | S | C | I | D | W | N | R | E | V | 16 | 13933 |
| 547 | C | I | D | W | N | R | E | V | L | K | R | E | L | G | L | 16 | 13934 |
| 634 | F | T | P | Y | H | M | L | H | G | E | V | H | C | G | T | 16 | 13935 |
| 180 | M | S | V | M | V | L | R | T | Q | G | P | A | A | L | F | 15 | 13936 |
| 610 | C | C | C | L | E | E | K | V | R | S | L | L | E | P | L | 15 | 13937 |
| 3 | L | Q | R | I | V | R | V | S | L | E | H | P | T | S | A | 14 | 13938 |
| 4 | Q | R | I | V | R | V | S | L | E | H | P | T | S | A | V | 14 | 13939 |
| 8 | R | V | S | L | E | H | P | T | S | A | V | C | V | A | G | 14 | 13940 |
| 20 | V | A | G | V | E | T | L | V | D | I | Y | G | S | V | P | 14 | 13941 |
| 23 | V | E | T | L | V | D | I | Y | G | S | V | P | E | G | T | 14 | 13942 |
| 24 | E | T | L | V | D | I | Y | G | S | V | P | E | G | T | E | 14 | 13943 |
| 26 | L | V | D | I | Y | G | S | V | P | E | G | T | E | M | F | 14 | 13944 |
| 36 | G | T | E | M | F | E | V | Y | G | T | P | G | V | D | I | 14 | 13945 |
| 39 | M | F | E | V | Y | G | T | P | G | V | D | I | Y | I | S | 14 | 13946 |
| 47 | G | V | D | I | Y | I | S | P | N | M | E | R | G | R | E | 14 | 13947 |
| 84 | S | N | D | L | N | D | S | H | V | Q | I | S | Y | H | S | 14 | 13948 |
| 89 | D | S | H | V | Q | I | S | Y | H | S | S | H | E | P | L | 14 | 13949 |
| 91 | H | V | Q | I | S | Y | H | S | S | H | E | P | L | P | L | 14 | 13950 |
| 100 | H | E | P | L | P | L | A | Y | A | V | L | Y | L | T | C | 14 | 13951 |
| 107 | Y | A | V | L | Y | L | T | C | V | D | I | S | L | D | C | 14 | 13952 |
| 109 | V | L | Y | L | T | C | V | D | I | S | L | D | C | D | L | 14 | 13953 |
| 112 | L | T | C | V | D | I | S | L | D | C | D | L | N | C | E | 14 | 13954 |
| 114 | C | V | D | I | S | L | D | C | D | L | N | C | E | G | R | 14 | 13955 |
| 146 | Y | G | G | I | L | L | V | N | C | D | R | D | D | P | S | 14 | 13956 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 148 | G | I | L | L | V | N | C | D | R | D | D | P | S | C | D | 14 | 13957 |
| 160 | S | C | D | V | Q | D | N | C | D | Q | H | V | H | C | L | 14 | 13958 |
| 168 | D | Q | H | V | H | C | L | Q | D | L | E | D | M | S | V | 14 | 13959 |
| 174 | L | Q | D | L | E | D | M | S | V | M | V | L | R | T | Q | 14 | 13960 |
| 177 | L | E | D | M | S | V | M | V | L | R | T | Q | G | P | A | 14 | 13961 |
| 181 | S | V | M | V | L | R | T | Q | G | P | A | A | L | F | D | 14 | 13962 |
| 182 | V | M | V | L | R | T | Q | G | P | A | A | L | F | D | D | 14 | 13963 |
| 196 | D | H | K | L | V | L | H | T | S | S | Y | D | A | K | R | 14 | 13964 |
| 198 | K | L | V | L | H | T | S | S | Y | D | A | K | R | A | Q | 14 | 13965 |
| 210 | R | A | Q | V | F | H | I | C | G | P | E | D | V | C | E | 14 | 13966 |
| 227 | R | H | V | L | G | Q | D | K | V | S | Y | E | V | P | R | 14 | 13967 |
| 232 | Q | D | K | V | S | Y | E | V | P | R | L | H | G | D | E | 14 | 13968 |
| 236 | S | Y | E | V | P | R | L | H | G | D | E | E | R | F | F | 14 | 13969 |
| 239 | V | P | R | L | H | G | D | E | E | R | F | F | V | E | G | 14 | 13970 |
| 251 | V | E | G | L | S | F | P | D | A | G | F | T | G | L | I | 14 | 13971 |
| 262 | T | G | L | I | S | F | H | V | T | L | L | D | D | S | N | 14 | 13972 |
| 266 | S | F | H | V | T | L | L | D | D | S | N | E | D | F | S | 14 | 13973 |
| 269 | V | T | L | L | D | D | S | N | E | D | F | S | A | S | P | 14 | 13974 |
| 281 | A | S | P | I | F | T | D | T | V | V | F | R | V | A | P | 14 | 13975 |
| 290 | V | F | R | V | A | P | W | I | M | T | P | S | T | L | P | 14 | 13976 |
| 294 | A | P | W | I | M | T | P | S | T | L | P | P | L | E | V | 14 | 13977 |
| 295 | P | W | I | M | T | P | S | T | L | P | P | L | E | V | Y | 14 | 13978 |
| 300 | P | S | T | L | P | P | L | E | V | Y | V | C | R | V | R | 14 | 13979 |
| 305 | P | L | E | V | Y | V | C | R | V | R | N | N | T | C | F | 14 | 13980 |
| 317 | T | C | F | V | D | A | V | A | E | L | A | R | K | A | G | 14 | 13981 |
| 333 | K | L | T | I | C | P | Q | A | E | N | R | N | D | R | W | 14 | 13982 |
| 345 | D | R | W | I | Q | D | E | M | E | L | G | Y | V | Q | A | 14 | 13983 |
| 361 | H | K | T | L | P | V | V | F | D | S | P | R | N | G | E | 14 | 13984 |
| 363 | T | L | P | V | V | F | D | S | P | R | N | G | E | L | Q | 14 | 13985 |
| 364 | L | P | V | V | F | D | S | P | R | N | G | E | L | Q | D | 14 | 13986 |
| 381 | Y | K | R | I | L | G | P | D | F | G | Y | V | T | R | E | 14 | 13987 |
| 407 | F | G | N | L | E | V | S | P | P | V | V | A | N | G | K | 14 | 13988 |
| 414 | P | P | V | V | A | N | G | K | E | Y | P | L | G | R | I | 14 | 13989 |
| 425 | L | G | R | I | L | I | G | G | N | L | P | G | S | S | G | 14 | 13990 |
| 426 | G | R | I | L | I | G | G | N | L | P | G | S | S | G | R | 14 | 13991 |
| 427 | R | I | L | I | G | G | N | L | P | G | S | S | G | R | R | 14 | 13992 |
| 431 | G | G | N | L | P | G | S | S | G | R | R | V | T | Q | V | 14 | 13993 |
| 452 | A | Q | K | V | Q | P | P | V | E | L | F | V | D | W | L | 14 | 13994 |
| 458 | P | V | E | L | F | V | D | W | L | A | V | G | H | V | Q | 14 | 13995 |
| 472 | D | E | F | L | S | F | V | P | A | P | D | G | K | G | F | 14 | 13996 |
| 485 | G | F | R | M | L | L | A | S | P | G | A | C | F | K | L | 14 | 13997 |
| 487 | R | M | L | L | A | S | P | G | A | C | F | K | L | F | Q | 14 | 13998 |
| 523 | V | K | T | I | S | I | N | Q | V | L | S | N | K | D | L | 14 | 13999 |
| 528 | I | N | Q | V | L | S | N | K | D | L | I | N | Y | N | K | 14 | 14000 |
| 534 | N | K | D | L | I | N | Y | N | K | F | V | Q | S | C | I | 14 | 14001 |
| 535 | K | D | L | I | N | Y | N | K | F | V | Q | S | C | I | D | 14 | 14002 |
| 545 | Q | S | C | I | D | W | N | R | E | V | L | K | R | E | L | 14 | 14003 |
| 552 | R | E | V | L | K | R | E | L | G | L | A | E | C | D | I | 14 | 14004 |
| 558 | E | L | G | L | A | E | C | D | I | I | D | I | P | Q | L | 14 | 14005 |
| 564 | C | D | I | I | D | I | P | Q | L | F | K | T | E | R | K | 14 | 14006 |
| 566 | I | I | D | I | P | Q | L | F | K | T | E | R | K | K | A | 14 | 14007 |
| 584 | F | P | D | L | V | N | M | L | V | L | G | K | H | L | G | 14 | 14008 |
| 585 | P | D | L | V | N | M | L | V | L | G | K | H | L | G | I | 14 | 14009 |
| 587 | L | V | N | M | L | V | L | G | K | H | L | G | I | P | K | 14 | 14010 |
| 590 | M | L | V | L | G | K | H | L | G | I | P | K | P | F | G | 14 | 14011 |
| 596 | H | L | G | I | P | K | P | F | G | P | I | I | N | G | C | 14 | 14012 |
| 614 | E | E | K | V | R | S | L | L | E | P | L | G | L | H | C | 14 | 14013 |
| 621 | L | E | P | L | G | L | H | C | T | F | I | D | D | F | T | 14 | 14014 |
| 641 | H | G | E | V | H | C | G | T | N | V | C | R | K | P | F | 14 | 14015 |
| 7 | V | R | V | S | L | E | H | P | T | S | A | V | C | V | A | 12 | 14016 |
| 12 | E | H | P | T | S | A | V | C | V | A | G | V | E | T | L | 12 | 14017 |
| 14 | P | T | S | A | V | C | V | A | G | V | E | T | L | V | D | 12 | 14018 |
| 18 | V | C | V | A | G | V | E | T | L | V | D | I | Y | G | S | 12 | 14019 |
| 21 | A | G | V | E | T | L | V | D | I | Y | G | S | V | P | E | 12 | 14020 |
| 22 | G | V | E | T | L | V | D | I | Y | G | S | V | P | E | G | 12 | 14021 |
| 29 | I | Y | G | S | V | P | E | G | T | E | M | F | E | V | Y | 12 | 14022 |
| 34 | P | E | G | T | E | M | F | E | V | Y | G | T | P | G | V | 12 | 14023 |
| 42 | V | Y | G | T | P | G | V | D | I | Y | I | S | P | N | M | 12 | 14024 |
| 44 | G | T | P | G | V | D | I | Y | I | S | P | N | M | E | R | 12 | 14025 |
| 57 | E | R | G | R | E | R | A | D | T | R | R | W | R | F | D | 12 | 14026 |
| 58 | R | G | R | E | R | A | D | T | R | R | W | R | F | D | A | 12 | 14027 |
| 66 | R | R | W | R | F | D | A | T | L | E | I | I | V | V | M | 12 | 14028 |
| 68 | W | R | F | D | A | T | L | E | I | I | V | V | M | N | S | 12 | 14029 |
| 69 | R | F | D | A | T | L | E | I | I | V | V | M | N | S | P | 12 | 14030 |
| 70 | F | D | A | T | L | E | I | I | V | V | M | N | S | P | S | 12 | 14031 |
| 80 | M | N | S | P | S | N | D | L | N | D | S | H | V | Q | I | 12 | 14032 |
| 81 | N | S | P | S | N | D | L | N | D | S | H | V | Q | I | S | 12 | 14033 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 82 | S | P | S | N | D | L | N | D | S | H | V | Q | I | S | Y | 12 | 14034 |
| 87 | L | N | D | S | H | V | Q | I | S | Y | H | S | S | H | E | 12 | 14035 |
| 88 | N | D | S | H | V | Q | I | S | Y | H | S | S | H | E | P | 12 | 14036 |
| 92 | V | Q | I | S | Y | H | S | S | H | E | P | L | P | L | A | 12 | 14037 |
| 95 | S | Y | H | S | S | H | E | P | L | P | L | A | Y | A | V | 12 | 14038 |
| 97 | H | S | S | H | E | P | L | P | L | A | Y | A | V | L | Y | 12 | 14039 |
| 99 | S | H | E | P | L | P | L | A | Y | A | V | L | Y | L | T | 12 | 14040 |
| 110 | L | Y | L | T | C | V | D | I | S | L | D | C | D | L | N | 12 | 14041 |
| 113 | T | C | V | D | I | S | L | D | C | D | L | N | C | E | G | 12 | 14042 |
| 121 | C | D | L | N | C | E | G | R | Q | D | R | N | F | V | D | 12 | 14043 |
| 123 | L | N | C | E | G | R | Q | D | R | N | F | V | D | K | R | 12 | 14044 |
| 124 | N | C | E | G | R | Q | D | R | N | F | V | D | K | R | Q | 12 | 14045 |
| 127 | G | R | Q | D | R | N | F | V | D | K | R | Q | W | V | W | 12 | 14046 |
| 145 | G | Y | G | G | I | L | L | V | N | C | D | R | D | D | P | 12 | 14047 |
| 156 | R | D | D | P | S | C | D | V | Q | D | N | C | D | Q | H | 12 | 14048 |
| 158 | D | P | S | C | D | V | Q | D | N | C | D | Q | H | V | H | 12 | 14049 |
| 162 | D | V | Q | D | N | C | D | Q | H | V | H | C | L | Q | D | 12 | 14050 |
| 164 | Q | D | N | C | D | Q | H | V | H | C | L | Q | D | L | E | 12 | 14051 |
| 170 | H | V | H | C | L | Q | D | L | E | D | M | S | V | M | V | 12 | 14052 |
| 172 | H | C | L | Q | D | L | E | D | M | S | V | M | V | L | R | 12 | 14053 |
| 176 | D | L | E | D | M | S | V | M | V | L | R | T | Q | G | P | 12 | 14054 |
| 178 | E | D | M | S | V | M | V | L | R | T | Q | G | P | A | A | 12 | 14055 |
| 187 | T | Q | G | P | A | A | L | F | D | D | H | K | L | V | L | 12 | 14056 |
| 188 | Q | G | P | A | A | L | F | D | D | H | K | L | V | L | H | 12 | 14057 |
| 193 | L | F | D | D | H | K | L | V | L | H | T | S | S | Y | D | 12 | 14058 |
| 195 | D | D | H | K | L | V | L | H | T | S | S | Y | D | A | K | 12 | 14059 |
| 201 | L | H | T | S | S | Y | D | A | K | R | A | Q | V | F | H | 12 | 14060 |
| 205 | S | Y | D | A | K | R | A | Q | V | F | H | I | C | G | P | 12 | 14061 |
| 207 | D | A | K | R | A | Q | V | F | H | I | C | G | P | E | D | 12 | 14062 |
| 214 | F | H | I | C | G | P | E | D | V | C | E | A | Y | R | H | 12 | 14063 |
| 218 | G | P | E | D | V | C | E | A | Y | R | H | V | L | G | Q | 12 | 14064 |
| 233 | D | K | V | S | Y | E | V | P | R | L | H | G | D | E | E | 12 | 14065 |
| 243 | H | G | D | E | E | R | F | F | V | E | G | L | S | F | P | 12 | 14066 |
| 244 | G | D | E | E | R | F | F | V | E | G | L | S | F | P | D | 12 | 14067 |
| 254 | L | S | F | P | D | A | G | F | T | G | L | I | S | F | H | 12 | 14068 |
| 255 | S | F | P | D | A | G | F | T | G | L | I | S | F | H | V | 12 | 14069 |
| 259 | A | G | F | T | G | L | I | S | F | H | V | T | L | L | D | 12 | 14070 |
| 260 | G | F | T | G | L | I | S | F | H | V | T | L | L | D | D | 12 | 14071 |
| 265 | I | S | F | H | V | T | L | L | D | D | S | N | E | D | F | 12 | 14072 |
| 267 | F | H | V | T | L | L | D | D | S | N | E | D | F | S | A | 12 | 14073 |
| 271 | L | L | D | D | S | N | E | D | F | S | A | S | P | I | F | 12 | 14074 |
| 272 | L | D | D | S | N | E | D | F | S | A | S | P | I | F | T | 12 | 14075 |
| 273 | D | D | S | N | E | D | F | S | A | S | P | I | F | T | D | 12 | 14076 |
| 275 | S | N | E | D | F | S | A | S | P | I | F | T | D | T | V | 12 | 14077 |
| 279 | F | S | A | S | P | I | F | T | D | T | V | V | F | R | V | 12 | 14078 |
| 283 | P | I | F | T | D | T | V | V | F | R | V | A | P | W | I | 12 | 14079 |
| 284 | I | F | T | D | T | V | V | F | R | V | A | P | W | I | M | 12 | 14080 |
| 297 | I | M | T | P | S | T | L | P | P | L | E | V | Y | V | C | 12 | 14081 |
| 302 | T | L | P | P | L | E | V | Y | V | C | R | V | R | N | N | 12 | 14082 |
| 309 | Y | V | C | R | V | R | N | N | T | C | F | V | D | A | V | 12 | 14083 |
| 313 | V | R | N | N | T | C | F | V | D | A | V | A | E | L | A | 12 | 14084 |
| 315 | N | N | T | C | F | V | D | A | V | A | E | L | A | R | K | 12 | 14085 |
| 318 | C | F | V | D | A | V | A | E | L | A | R | K | A | G | C | 12 | 14086 |
| 319 | F | V | D | A | V | A | E | L | A | R | K | A | G | C | K | 12 | 14087 |
| 324 | A | E | L | A | R | K | A | G | C | K | L | T | I | C | P | 12 | 14088 |
| 328 | R | K | A | G | C | K | L | T | I | C | P | Q | A | E | N | 12 | 14089 |
| 334 | L | T | I | C | P | Q | A | E | N | R | N | D | R | W | I | 12 | 14090 |
| 335 | T | I | C | P | Q | A | E | N | R | N | D | R | W | I | Q | 12 | 14091 |
| 338 | P | Q | A | E | N | R | N | D | R | W | I | Q | D | E | M | 12 | 14092 |
| 341 | E | N | R | N | D | R | W | I | Q | D | E | M | E | L | G | 12 | 14093 |
| 347 | W | I | Q | D | E | M | E | L | G | Y | V | Q | A | P | H | 12 | 14094 |
| 348 | I | Q | D | E | M | E | L | G | Y | V | Q | A | P | H | K | 12 | 14095 |
| 355 | G | Y | V | Q | A | P | H | K | T | L | P | V | V | F | D | 12 | 14096 |
| 369 | D | S | P | R | N | G | E | L | Q | D | F | P | Y | K | R | 12 | 14097 |
| 392 | V | T | R | E | P | R | D | R | S | V | S | G | L | D | S | 12 | 14098 |
| 395 | E | P | R | D | R | S | V | S | G | L | D | S | F | G | N | 12 | 14099 |
| 399 | R | S | V | S | G | L | D | S | F | G | N | L | E | V | S | 12 | 14100 |
| 406 | S | F | G | N | L | E | V | S | P | P | V | V | A | N | G | 12 | 14101 |
| 410 | L | E | V | S | P | P | V | V | A | N | G | K | E | Y | P | 12 | 14102 |
| 411 | E | V | S | P | P | V | V | A | N | G | K | E | Y | P | L | 12 | 14103 |
| 423 | Y | P | L | G | R | I | L | I | G | G | N | L | P | G | S | 12 | 14104 |
| 432 | G | N | L | P | G | S | S | G | R | R | V | T | Q | V | V | 12 | 14105 |
| 433 | N | L | P | G | S | S | G | R | R | V | T | Q | V | V | R | 12 | 14106 |
| 436 | G | S | S | G | R | R | V | T | Q | V | V | R | D | F | L | 12 | 14107 |
| 444 | Q | V | V | R | D | F | L | H | A | Q | K | V | Q | P | P | 12 | 14108 |
| 445 | V | V | R | D | F | L | H | A | Q | K | V | Q | P | P | V | 12 | 14109 |
| 455 | V | Q | P | P | V | E | L | F | V | D | W | L | A | V | G | 12 | 14110 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 457 | P | P | V | E | L | F | V | D | W | L | A | V | G | H | V | 12 | 14111 |
| 467 | A | V | G | H | V | D | E | F | L | S | F | V | P | A | P | 12 | 14112 |
| 469 | G | H | V | D | E | F | L | S | F | V | P | A | P | D | G | 12 | 14113 |
| 479 | P | A | P | D | G | K | G | F | R | M | L | L | A | S | P | 12 | 14114 |
| 480 | A | P | D | G | K | G | F | R | M | L | L | A | S | P | G | 12 | 14115 |
| 500 | F | Q | E | K | Q | K | C | G | H | G | R | A | L | L | F | 12 | 14116 |
| 502 | E | K | Q | K | C | G | H | G | R | A | L | L | F | Q | G | 12 | 14117 |
| 506 | C | G | H | G | R | A | L | L | F | Q | G | V | V | D | D | 12 | 14118 |
| 512 | L | L | F | Q | G | V | V | D | D | E | Q | V | K | T | I | 12 | 14119 |
| 513 | L | F | Q | G | V | V | D | D | E | Q | V | K | T | I | S | 12 | 14120 |
| 519 | D | D | E | Q | V | K | T | I | S | I | N | Q | V | L | S | 12 | 14121 |
| 521 | E | Q | V | K | T | I | S | I | N | Q | V | L | S | N | K | 12 | 14122 |
| 530 | Q | V | L | S | N | K | D | L | I | N | Y | N | K | F | V | 12 | 14123 |
| 533 | S | N | K | D | L | I | N | Y | N | K | F | V | Q | S | C | 12 | 14124 |
| 538 | I | N | Y | N | K | F | V | Q | S | C | I | D | W | N | R | 12 | 14125 |
| 544 | V | Q | S | C | I | D | W | N | R | E | V | L | K | R | E | 12 | 14126 |
| 548 | I | D | W | N | R | E | V | L | K | R | E | L | G | L | A | 12 | 14127 |
| 549 | D | W | N | R | E | V | L | K | R | E | L | G | L | A | E | 12 | 14128 |
| 555 | L | K | R | E | L | G | L | A | E | C | D | I | I | D | I | 12 | 14129 |
| 560 | G | L | A | E | C | D | I | I | D | I | P | Q | L | F | K | 12 | 14130 |
| 561 | L | A | E | C | D | I | I | D | I | P | Q | L | F | K | T | 12 | 14131 |
| 576 | E | R | K | K | A | T | A | F | F | P | D | L | V | N | M | 12 | 14132 |
| 577 | R | K | K | A | T | A | F | F | P | D | L | V | N | M | L | 12 | 14133 |
| 578 | K | K | A | T | A | F | F | P | D | L | V | N | M | L | V | 12 | 14134 |
| 582 | A | F | F | P | D | L | V | N | M | L | V | L | G | K | H | 12 | 14135 |
| 586 | D | L | V | N | M | L | V | L | G | K | H | L | G | I | P | 12 | 14136 |
| 597 | L | G | I | P | K | P | F | G | P | I | I | N | G | C | C | 12 | 14137 |
| 608 | N | G | C | C | C | L | E | E | K | V | R | S | L | L | E | 12 | 14138 |
| 609 | G | C | C | C | L | E | E | K | V | R | S | L | L | E | P | 12 | 14139 |
| 611 | C | C | L | E | E | K | V | R | S | L | L | E | P | L | G | 12 | 14140 |
| 615 | E | K | V | R | S | L | L | E | P | L | G | L | H | C | T | 12 | 14141 |
| 620 | L | L | E | P | L | G | L | H | C | T | F | I | D | D | F | 12 | 14142 |
| 624 | L | G | L | H | C | T | F | I | D | D | F | T | P | Y | H | 12 | 14143 |
| 633 | D | F | T | P | Y | H | M | L | H | G | E | V | H | C | G | 12 | 14144 |
| 638 | H | M | L | H | G | E | V | H | C | G | T | N | V | C | R | 12 | 14145 |
| 644 | V | H | C | G | T | N | V | C | R | K | P | F | S | F | K | 12 | 14146 |
| 130 | D | R | N | F | V | D | K | R | Q | W | V | W | G | P | S | 11 | 14147 |
| 40 | F | E | V | Y | G | T | P | G | V | D | I | Y | I | S | P | 10 | 14148 |
| 48 | V | D | I | Y | I | S | P | N | M | E | R | G | R | E | R | 10 | 14149 |
| 93 | Q | I | S | Y | H | S | S | H | E | P | L | P | L | A | Y | 10 | 14150 |
| 191 | A | L | F | D | D | H | K | L | V | L | H | T | S | S | S | 10 | 14151 |
| 234 | K | V | S | Y | E | V | P | R | L | H | G | D | E | E | R | 10 | 14152 |
| 276 | N | E | D | F | S | A | S | P | I | F | T | D | T | V | V | 10 | 14153 |
| 420 | G | K | E | Y | P | L | G | R | I | L | I | G | G | N | L | 10 | 14154 |
| 459 | V | E | L | F | V | D | W | L | A | V | G | H | V | D | E | 10 | 14155 |
| 631 | I | D | D | F | T | P | Y | H | M | L | H | G | E | V | H | 10 | 14156 |
| 286 | T | D | T | V | V | F | R | V | A | P | W | I | M | T | P | 9 | 14157 |
| 323 | V | A | E | L | A | R | K | A | G | C | K | L | T | I | C | 9 | 14158 |
| 551 | N | R | E | V | L | K | R | E | L | G | L | A | E | C | D | 9 | 14159 |
| 647 | G | T | N | V | C | R | K | P | F | S | F | K | W | W | N | 9 | 14160 |
| 30 | Y | G | S | V | P | E | G | T | E | M | F | E | V | Y | G | 8 | 14161 |
| 49 | D | I | Y | I | S | P | N | M | E | R | G | R | E | R | A | 8 | 14162 |
| 53 | S | P | N | M | E | R | G | R | E | R | A | D | T | R | R | 8 | 14163 |
| 75 | E | I | I | V | V | M | N | S | P | S | N | D | L | N | D | 8 | 14164 |
| 137 | R | Q | W | V | W | G | P | S | G | Y | G | G | I | L | L | 8 | 14165 |
| 147 | G | G | I | L | L | V | N | C | D | R | D | D | P | S | C | 8 | 14166 |
| 213 | V | F | H | I | C | G | P | E | D | V | C | E | A | Y | R | 8 | 14167 |
| 226 | Y | R | H | V | L | G | Q | D | K | V | S | Y | E | V | P | 8 | 14168 |
| 303 | L | P | P | L | E | V | Y | V | C | R | V | R | N | N | T | 8 | 14169 |
| 310 | V | C | R | V | R | N | N | T | C | F | V | D | A | V | A | 8 | 14170 |
| 349 | Q | D | E | M | E | L | G | Y | V | Q | A | P | H | K | T | 8 | 14171 |
| 354 | L | G | Y | V | Q | A | P | H | K | T | L | P | V | V | F | 8 | 14172 |
| 409 | N | L | E | V | S | P | P | V | V | A | N | G | K | E | Y | 8 | 14173 |
| 413 | S | P | P | V | V | A | N | G | K | E | Y | P | L | G | R | 8 | 14174 |
| 447 | R | D | F | L | H | A | Q | K | V | Q | P | P | V | E | L | 8 | 14175 |
| 463 | V | D | W | L | A | V | G | H | V | D | E | F | L | S | F | 8 | 14176 |
| 475 | L | S | F | V | P | A | P | D | G | K | G | F | R | M | L | 8 | 14177 |
| 486 | F | R | M | L | L | A | S | P | G | A | C | F | K | L | F | 8 | 14178 |
| 509 | G | R | A | L | L | F | Q | G | V | V | D | D | E | Q | V | 8 | 14179 |
| 510 | R | A | L | L | F | Q | G | V | V | D | D | E | Q | V | K | 8 | 14180 |
| 541 | N | K | F | V | Q | S | C | I | D | W | N | R | E | V | L | 8 | 14181 |
| 594 | G | K | H | L | G | I | P | K | P | F | G | P | I | I | N | 8 | 14182 |
| 603 | F | G | P | I | I | N | G | C | C | C | L | E | E | K | V | 8 | 14183 |
| 604 | G | P | I | I | N | G | C | C | C | L | E | E | K | V | R | 8 | 14184 |
| 617 | V | R | S | L | L | E | P | L | G | L | H | C | T | F | I | 8 | 14185 |
| 623 | P | L | G | L | H | C | T | F | I | D | D | F | T | P | Y | 8 | 14186 |
| 636 | P | Y | H | M | L | H | G | E | V | H | C | G | T | N | V | 8 | 14187 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 52 | I | S | P | N | M | E | R | G | R | E | R | A | D | T | R | 7 | 14188 |
| 54 | P | N | M | E | R | G | R | E | R | A | D | T | R | R | W | 7 | 14189 |
| 61 | E | R | A | D | T | R | R | W | R | F | D | A | T | L | E | 7 | 14190 |
| 228 | H | V | L | G | Q | D | K | V | S | Y | E | V | P | R | L | 7 | 14191 |
| 391 | Y | V | T | R | E | P | R | D | R | S | V | S | G | L | D | 7 | 14192 |
| 435 | P | G | S | S | G | R | R | V | T | Q | V | V | R | D | F | 7 | 14193 |
| 448 | D | F | L | H | A | Q | K | V | Q | P | P | V | E | L | F | 7 | 14194 |
| 1 | M | S | L | Q | R | I | V | R | V | S | L | E | H | P | T | 6 | 14195 |
| 9 | V | S | L | E | H | P | T | S | A | V | C | V | A | G | V | 6 | 14196 |
| 10 | S | L | E | H | P | T | S | A | V | C | V | A | G | V | E | 6 | 14197 |
| 11 | L | E | H | P | T | S | A | V | C | V | A | G | V | E | T | 6 | 14198 |
| 16 | S | A | V | C | V | A | G | V | E | T | L | V | D | I | Y | 6 | 14199 |
| 28 | D | I | Y | G | S | V | P | E | G | T | E | M | F | E | V | 6 | 14200 |
| 31 | G | S | V | P | E | G | T | E | N | F | E | V | Y | G | T | 6 | 14201 |
| 32 | S | V | P | E | G | T | E | M | F | E | V | Y | G | T | P | 6 | 14202 |
| 35 | E | G | T | E | M | F | E | V | Y | G | T | P | G | V | D | 6 | 14203 |
| 41 | E | V | Y | G | T | P | G | V | D | I | Y | I | S | P | N | 6 | 14204 |
| 43 | Y | G | T | P | G | V | D | I | Y | I | S | P | N | M | E | 6 | 14205 |
| 46 | P | G | V | D | I | Y | I | S | P | N | M | E | R | G | R | 6 | 14206 |
| 50 | I | Y | I | S | P | N | M | E | R | G | R | E | R | A | D | 6 | 14207 |
| 51 | Y | I | S | P | N | M | E | R | G | R | E | R | A | D | T | 6 | 14208 |
| 55 | N | M | E | R | G | R | E | R | A | D | T | R | R | W | R | 6 | 14209 |
| 59 | G | R | E | R | A | D | T | R | R | W | R | F | D | A | T | 6 | 14210 |
| 62 | R | A | D | T | R | R | W | R | F | D | A | T | L | E | I | 6 | 14211 |
| 64 | D | T | R | R | W | R | F | D | A | T | L | E | I | I | V | 6 | 14212 |
| 72 | A | T | L | E | I | I | V | V | M | N | S | P | S | N | D | 6 | 14213 |
| 79 | V | M | N | S | P | S | N | D | L | N | D | S | H | V | Q | 6 | 14214 |
| 85 | N | D | L | N | D | S | H | V | Q | I | S | Y | H | S | S | 6 | 14215 |
| 86 | D | L | N | D | S | H | V | Q | I | S | Y | H | S | S | H | 6 | 14216 |
| 90 | S | H | V | Q | I | S | Y | H | S | S | H | E | P | L | P | 6 | 14217 |
| 94 | I | S | Y | H | S | S | H | E | P | L | P | L | A | Y | A | 6 | 14218 |
| 98 | S | S | H | E | P | L | P | L | A | Y | A | V | L | Y | L | 6 | 14219 |
| 101 | E | P | L | P | L | A | Y | A | V | L | Y | L | T | C | V | 6 | 14220 |
| 103 | L | P | L | A | Y | A | V | L | Y | L | T | C | V | D | I | 6 | 14221 |
| 105 | L | A | Y | A | V | L | Y | L | T | C | V | D | I | S | L | 6 | 14222 |
| 111 | Y | L | T | C | V | D | I | S | L | D | C | D | L | N | C | 6 | 14223 |
| 117 | I | S | L | D | C | D | L | N | C | E | G | R | Q | D | R | 6 | 14224 |
| 118 | S | L | D | C | D | L | N | C | E | G | R | Q | D | R | N | 6 | 14225 |
| 128 | R | Q | D | R | N | F | V | D | K | R | Q | W | V | W | G | 6 | 14226 |
| 133 | F | V | D | K | R | Q | W | V | W | G | P | S | G | Y | G | 6 | 14227 |
| 134 | V | D | K | R | Q | W | V | W | G | P | S | G | Y | G | G | 6 | 14228 |
| 139 | W | V | W | G | P | S | G | Y | G | G | I | L | L | V | N | 6 | 14229 |
| 140 | V | W | G | P | S | G | Y | G | G | I | L | L | V | N | C | 6 | 14230 |
| 141 | W | G | P | S | G | Y | Q | G | I | L | L | V | N | C | D | 6 | 14231 |
| 142 | G | P | S | G | Y | G | G | I | L | L | V | N | C | D | R | 6 | 14232 |
| 144 | S | G | Y | G | G | I | L | L | V | N | C | D | R | D | D | 6 | 14233 |
| 151 | L | V | N | C | D | R | D | D | P | S | C | D | V | Q | D | 6 | 14234 |
| 153 | N | C | D | R | D | D | P | S | C | D | V | Q | D | N | C | 6 | 14235 |
| 155 | D | R | D | D | P | S | C | D | V | Q | D | N | C | D | Q | 6 | 14236 |
| 157 | D | D | P | S | C | D | V | Q | D | N | C | D | Q | H | V | 6 | 14237 |
| 159 | P | S | C | D | V | Q | D | N | C | D | Q | H | V | H | C | 6 | 14238 |
| 161 | C | D | V | Q | D | N | C | D | Q | H | V | H | C | L | Q | 6 | 14239 |
| 163 | V | Q | D | N | C | D | Q | H | V | H | C | L | Q | D | L | 6 | 14240 |
| 165 | D | N | C | D | Q | H | V | H | C | L | Q | D | L | E | D | 6 | 14241 |
| 166 | N | C | D | Q | H | V | H | C | L | Q | D | L | E | D | M | 6 | 14242 |
| 167 | C | D | Q | H | V | H | C | L | Q | D | L | E | D | M | S | 6 | 14243 |
| 169 | Q | H | V | H | C | L | Q | D | L | E | D | M | S | V | M | 6 | 14244 |
| 185 | L | R | T | Q | G | P | A | A | L | F | D | D | H | K | L | 6 | 14245 |
| 186 | R | T | Q | G | P | A | A | L | F | D | D | H | K | L | V | 6 | 14246 |
| 200 | V | L | H | T | S | S | Y | D | A | K | R | A | Q | V | F | 6 | 14247 |
| 208 | A | K | R | A | Q | V | F | H | I | C | G | P | E | D | V | 6 | 14248 |
| 215 | H | I | C | G | P | E | D | V | C | E | A | Y | R | H | V | 6 | 14249 |
| 216 | I | C | G | P | E | D | V | C | E | A | Y | R | H | V | L | 6 | 14250 |
| 220 | E | D | V | C | E | A | Y | R | H | V | L | G | Q | D | K | 6 | 14251 |
| 225 | A | Y | R | H | V | L | G | Q | D | K | V | S | Y | E | V | 6 | 14252 |
| 229 | V | L | G | Q | D | K | V | S | Y | E | V | P | R | L | H | 6 | 14253 |
| 231 | G | Q | D | K | V | S | Y | E | V | P | R | L | H | G | D | 6 | 14254 |
| 241 | R | L | H | G | D | E | E | R | F | F | V | E | G | L | S | 6 | 14255 |
| 245 | D | E | E | R | F | F | V | E | G | L | S | F | P | D | A | 6 | 14256 |
| 250 | F | V | E | G | L | S | F | P | D | A | G | F | T | G | L | 6 | 14257 |
| 252 | E | G | L | S | F | P | D | A | G | F | T | G | L | I | S | 6 | 14258 |
| 263 | G | L | I | S | F | H | V | T | L | L | D | D | S | N | E | 6 | 14259 |
| 270 | T | L | L | D | D | S | N | E | D | F | S | A | S | P | I | 6 | 14260 |
| 274 | D | S | N | E | D | F | S | A | S | P | I | F | T | D | T | 6 | 14261 |
| 277 | E | D | F | S | A | S | P | I | F | T | D | T | V | V | F | 6 | 14262 |
| 280 | S | A | S | P | I | F | T | D | T | V | V | F | R | V | A | 6 | 14263 |
| 285 | F | T | D | T | V | V | F | R | V | A | P | W | I | M | T | 6 | 14264 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 292 | R | V | A | P | W | I | M | T | P | S | T | L | P | P | L | 6 | 14265 |
| 299 | T | P | S | T | L | P | P | L | E | V | Y | V | C | R | V | 6 | 14266 |
| 301 | S | T | L | P | P | L | E | V | Y | V | C | R | V | R | N | 6 | 14267 |
| 311 | C | R | V | R | N | N | T | C | F | V | D | A | V | A | E | 6 | 14268 |
| 312 | R | V | R | N | N | T | C | F | V | D | A | V | A | E | L | 6 | 14269 |
| 314 | R | N | N | T | C | F | V | D | A | V | A | E | L | A | R | 6 | 14270 |
| 321 | D | A | V | A | E | L | A | R | K | A | G | C | K | L | T | 6 | 14271 |
| 325 | E | L | A | R | K | A | G | C | K | L | T | I | C | P | Q | 6 | 14272 |
| 329 | K | A | G | C | K | L | T | I | C | P | Q | A | E | N | R | 6 | 14273 |
| 330 | A | G | C | K | L | T | I | C | P | Q | A | E | N | R | N | 6 | 14274 |
| 336 | I | C | P | Q | A | E | N | R | N | D | R | W | I | Q | D | 6 | 14275 |
| 339 | Q | A | E | N | R | N | D | R | W | I | Q | D | E | M | E | 6 | 14276 |
| 342 | N | R | N | D | R | W | I | Q | D | E | M | E | L | G | Y | 6 | 14277 |
| 343 | R | N | D | R | W | I | Q | D | E | M | E | L | G | Y | V | 6 | 14278 |
| 346 | R | W | I | Q | D | E | M | E | L | G | Y | V | Q | A | P | 6 | 14279 |
| 350 | D | E | M | E | L | G | Y | V | Q | A | P | H | K | T | L | 6 | 14280 |
| 352 | M | E | L | G | Y | V | Q | A | P | H | K | T | L | P | V | 6 | 14281 |
| 358 | Q | A | P | H | K | T | L | P | V | V | F | D | S | P | R | 6 | 14282 |
| 359 | A | P | H | K | T | L | P | V | V | F | D | S | P | R | N | 6 | 14283 |
| 360 | P | H | K | T | L | P | V | V | F | D | S | P | R | N | G | 6 | 14284 |
| 370 | S | P | R | N | G | E | L | Q | D | F | P | Y | K | R | I | 6 | 14285 |
| 371 | P | R | N | G | E | L | Q | D | F | P | Y | K | R | I | L | 6 | 14286 |
| 372 | R | N | G | E | L | Q | D | F | P | Y | K | R | I | L | G | 6 | 14287 |
| 374 | G | E | L | Q | D | F | P | Y | K | R | I | L | G | P | D | 6 | 14288 |
| 375 | E | L | Q | D | F | P | Y | K | R | I | L | G | P | D | F | 6 | 14289 |
| 379 | F | P | Y | K | R | I | L | G | P | D | F | G | Y | V | T | 6 | 14290 |
| 383 | R | I | L | G | P | D | F | G | Y | V | T | R | E | P | R | 6 | 14291 |
| 385 | L | G | P | D | F | G | Y | V | T | R | E | P | R | D | R | 6 | 14292 |
| 390 | G | Y | V | T | R | E | P | R | D | R | S | V | S | G | L | 6 | 14293 |
| 394 | R | E | P | R | D | R | S | V | S | G | L | D | S | F | G | 6 | 14294 |
| 402 | S | G | L | D | S | F | G | N | L | E | V | S | P | P | V | 6 | 14295 |
| 408 | G | N | L | E | V | S | P | P | V | V | A | N | G | K | E | 6 | 14296 |
| 412 | V | S | P | P | V | V | A | N | G | K | E | Y | P | L | G | 6 | 14297 |
| 416 | V | V | A | N | G | K | E | Y | P | L | G | R | I | L | I | 6 | 14298 |
| 417 | V | A | N | G | K | E | Y | P | L | G | R | I | L | I | G | 6 | 14299 |
| 418 | A | N | G | K | E | Y | P | L | G | R | I | L | I | G | G | 6 | 14300 |
| 424 | P | L | G | R | I | L | I | G | G | N | L | P | G | S | S | 6 | 14301 |
| 428 | I | L | I | G | G | N | L | P | G | S | S | G | R | R | V | 6 | 14302 |
| 429 | L | I | G | G | N | L | P | G | S | S | G | R | R | V | T | 6 | 14303 |
| 430 | I | G | G | N | L | P | G | S | S | G | R | R | V | T | Q | 6 | 14304 |
| 440 | R | R | V | T | Q | V | V | R | D | F | L | H | A | Q | K | 6 | 14305 |
| 449 | F | L | H | A | Q | K | V | Q | P | P | V | E | L | F | V | 6 | 14306 |
| 450 | L | H | A | Q | K | V | Q | P | P | V | E | L | F | V | D | 6 | 14307 |
| 453 | Q | K | V | Q | P | P | V | E | L | F | V | D | W | L | A | 6 | 14308 |
| 454 | K | V | Q | P | P | V | E | L | F | V | D | W | L | A | V | 6 | 14309 |
| 461 | L | F | V | D | W | L | A | V | G | H | V | D | E | F | L | 6 | 14310 |
| 464 | D | W | L | A | V | G | H | V | D | E | F | L | S | F | V | 6 | 14311 |
| 466 | L | A | V | G | H | V | D | E | F | L | S | F | V | P | A | 6 | 14312 |
| 473 | E | F | L | S | F | V | P | A | P | D | G | K | G | F | R | 6 | 14313 |
| 476 | S | F | V | P | A | P | D | G | K | G | F | R | M | L | L | 6 | 14314 |
| 477 | F | V | P | A | P | D | G | K | G | F | R | M | L | L | A | 6 | 14315 |
| 488 | M | L | L | A | S | P | G | A | C | F | K | L | F | Q | E | 6 | 14316 |
| 489 | L | L | A | S | P | G | A | C | F | K | L | F | Q | E | K | 6 | 14317 |
| 490 | L | A | S | P | G | A | C | F | K | L | F | Q | E | K | Q | 6 | 14318 |
| 491 | A | S | P | G | A | C | F | K | L | F | Q | E | K | Q | K | 6 | 14319 |
| 501 | Q | E | K | Q | K | C | G | H | G | R | A | L | L | F | Q | 6 | 14320 |
| 505 | K | C | G | H | G | R | A | L | L | F | Q | G | V | V | D | 6 | 14321 |
| 508 | H | G | R | A | L | L | F | Q | G | V | V | D | D | E | Q | 6 | 14322 |
| 516 | G | V | V | D | D | E | Q | V | K | T | I | S | I | N | Q | 6 | 14323 |
| 524 | K | T | I | S | I | N | Q | V | L | S | N | K | D | L | I | 6 | 14324 |
| 527 | S | I | N | Q | V | L | S | N | K | D | L | I | N | Y | N | 6 | 14325 |
| 532 | L | S | N | K | D | L | I | N | Y | N | K | F | V | Q | S | 6 | 14326 |
| 542 | K | F | V | Q | S | C | I | D | W | N | R | E | V | L | K | 6 | 14327 |
| 553 | E | V | L | K | R | E | L | G | L | A | E | C | D | I | I | 6 | 14328 |
| 557 | R | E | L | G | L | A | E | C | D | I | I | D | I | P | Q | 6 | 14329 |
| 559 | L | G | L | A | E | C | D | I | I | D | I | P | Q | L | F | 6 | 14330 |
| 562 | A | E | C | D | I | I | D | I | P | Q | L | F | K | T | E | 6 | 14331 |
| 574 | K | T | E | R | K | K | A | T | A | F | F | P | D | L | V | 6 | 14332 |
| 579 | K | A | T | A | F | F | P | D | L | V | N | M | L | V | L | 6 | 14333 |
| 591 | L | V | L | G | K | H | L | G | I | P | K | P | F | G | P | 6 | 14334 |
| 593 | L | G | K | H | L | G | I | P | K | P | F | G | P | I | I | 6 | 14335 |
| 601 | K | P | F | G | P | I | I | N | G | C | C | C | L | E | E | 6 | 14336 |
| 602 | P | F | G | P | I | I | N | G | C | C | C | L | E | E | K | 6 | 14337 |
| 605 | P | I | I | N | G | C | C | C | L | E | E | K | V | R | S | 6 | 14338 |
| 606 | I | I | N | G | C | C | C | L | E | E | K | V | R | S | L | 6 | 14339 |
| 607 | I | N | G | C | C | C | L | E | E | K | V | R | S | L | L | 6 | 14340 |
| 613 | L | E | E | K | V | R | S | L | L | E | P | L | G | L | H | 6 | 14341 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 616 | K | V | R | S | L | L | E | P | L | G | L | H | C | T | F | 6 | 14342 |
| 619 | S | L | L | E | P | L | G | L | H | C | T | F | I | D | D | 6 | 14343 |
| 625 | G | L | H | C | T | F | I | D | D | F | T | P | Y | H | M | 6 | 14344 |
| 626 | L | H | C | T | F | I | D | D | F | T | P | Y | H | M | L | 6 | 14345 |
| 629 | T | F | I | D | D | F | T | P | Y | H | M | L | H | G | E | 6 | 14346 |
| 630 | F | I | D | D | F | T | P | Y | H | M | L | H | G | E | V | 6 | 14347 |
| 639 | M | L | H | G | E | V | H | C | G | T | N | V | C | R | K | 6 | 14348 |
| 640 | L | H | G | E | V | H | C | G | T | N | V | C | R | K | P | 6 | 14349 |
| 642 | G | E | V | H | C | G | T | N | V | C | R | K | P | F | S | 6 | 14350 |
| 645 | H | C | G | T | N | V | C | R | K | P | F | S | F | K | W | 6 | 14351 |
| 648 | T | N | V | C | R | K | P | F | S | F | K | W | W | N | M | 6 | 14352 |
| 649 | N | V | C | R | K | P | F | S | F | K | W | W | N | M | V | 6 | 14353 |
| 650 | V | C | R | K | P | F | S | F | K | W | W | N | M | V | P | 6 | 14354 |
| 203 | T | S | S | Y | D | A | K | R | A | Q | V | F | H | I | C | 5 | 14355 |
| 376 | L | Q | D | F | P | Y | K | R | I | L | G | P | D | F | G | 5 | 14356 |
| 388 | D | F | G | Y | V | T | R | E | P | R | D | R | S | V | S | 5 | 14357 |
| 497 | F | K | L | F | Q | E | K | Q | K | C | G | H | G | R | A | 5 | 14358 |
| 131 | R | N | F | V | D | K | R | Q | W | V | W | G | P | S | G | 3 | 14359 |
| 529 | N | Q | V | L | S | N | K | D | L | I | N | Y | N | K | F | 3 | 14360 |
| 589 | N | M | L | V | L | G | K | H | L | G | I | P | K | P | F | 3 | 14361 |
| 2 | S | L | Q | R | I | V | R | V | S | L | E | H | P | T | S | 1 | 14362 |
| 63 | A | D | T | R | R | W | R | F | D | A | T | L | E | I | I | 1 | 14363 |
| 125 | C | E | G | R | Q | D | R | N | F | V | D | K | R | Q | W | 1 | 14364 |
| 192 | A | L | F | D | D | H | K | L | V | L | H | T | S | S | Y | 1 | 14365 |
| 204 | S | S | Y | D | A | K | R | A | Q | V | F | H | I | C | G | 1 | 14366 |
| 221 | D | V | C | E | A | Y | R | H | V | L | G | Q | D | K | V | 1 | 14367 |
| 235 | V | S | Y | E | V | P | R | L | H | G | D | E | E | R | F | 1 | 14368 |
| 308 | V | Y | V | C | R | V | R | N | N | T | C | F | V | D | A | 1 | 14369 |
| 322 | A | V | A | E | L | A | R | K | A | G | C | K | L | T | I | 1 | 14370 |
| 327 | A | R | K | A | G | C | K | L | T | I | C | P | Q | A | E | 1 | 14371 |
| 337 | C | P | Q | A | E | N | R | N | D | R | W | I | Q | D | E | 1 | 14372 |
| 356 | Y | V | Q | A | P | H | K | T | L | P | V | V | F | D | S | 1 | 14373 |
| 366 | V | V | F | D | S | P | R | N | G | E | L | Q | D | F | P | 1 | 14374 |
| 393 | T | R | E | P | R | D | R | S | V | S | G | L | D | S | F | 1 | 14375 |
| 434 | L | P | G | S | S | G | R | R | V | T | Q | V | R | D | 1 | 14376 |
| 441 | R | V | T | Q | V | V | R | D | F | L | H | A | Q | K | V | 1 | 14377 |
| 478 | V | P | A | P | D | G | K | G | F | R | M | L | L | A | S | 1 | 14378 |
| 481 | P | D | G | K | G | F | R | M | L | L | A | S | P | G | A | 1 | 14379 |
| 492 | S | P | G | A | C | F | K | L | F | Q | E | K | Q | K | C | 1 | 14380 |
| 504 | Q | K | C | G | H | G | R | A | L | L | F | Q | G | V | V | 1 | 14381 |
| 518 | V | D | D | E | Q | V | K | T | I | S | I | N | Q | V | L | 1 | 14382 |
| 550 | W | N | R | E | V | L | K | R | E | L | G | L | A | E | C | 1 | 14383 |
| 568 | D | I | P | Q | L | F | K | T | E | R | K | K | A | T | A | 1 | 14384 |
| 571 | Q | L | F | K | T | E | R | K | K | A | T | A | F | F | P | 1 | 14385 |
| 573 | F | K | T | E | R | K | K | A | T | A | F | F | P | D | L | 1 | 14386 |
| 595 | K | H | L | G | I | P | K | P | F | G | P | I | I | N | G | 1 | 14387 |
| 56 | M | E | R | G | R | E | R | A | D | T | R | R | W | R | F | −5 | 14388 |
| 60 | R | E | R | A | D | T | R | R | W | R | F | D | A | T | L | −5 | 14389 |
| 122 | D | L | N | C | E | G | R | Q | D | R | N | F | V | D | K | −5 | 14390 |
| 150 | L | L | V | N | C | D | R | D | D | P | S | C | D | V | Q | −5 | 14391 |
| 242 | L | H | G | D | E | E | R | F | F | V | E | G | L | S | F | −5 | 14392 |
| 340 | A | E | N | R | N | D | R | W | I | Q | D | E | M | E | L | −5 | 14393 |
| 377 | Q | D | F | P | Y | K | R | I | L | G | P | D | F | G | Y | −5 | 14394 |
| 415 | P | V | V | A | N | G | K | E | Y | P | L | G | R | I | L | −5 | 14395 |
| 421 | K | E | Y | P | L | G | R | I | L | I | G | N | L | P | −5 | 14396 |
| 499 | L | F | Q | E | K | Q | K | C | G | H | G | R | A | L | L | −5 | 14397 |
| 536 | D | L | I | N | Y | N | K | F | V | Q | S | C | I | D | W | −5 | 14398 |
| 546 | S | C | I | D | W | N | R | E | V | L | K | R | E | L | G | −5 | 14399 |
| 572 | L | F | K | T | E | R | K | K | A | T | A | F | F | P | D | −5 | 14400 |
| 612 | C | L | E | E | K | V | R | S | L | L | E | P | L | G | L | −5 | 14401 |
| 646 | C | G | T | N | V | C | R | K | P | F | S | F | K | W | W | −5 | 14402 |

184P1E2 v.2: HLA Peptide Scoring Results DRB1 0401 15-mers SYFPEITHI

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 4 | V | A | P | W | I | M | T | P | S | T | L | A | P | L | E | 22 | 14403 |
| 2 | F | R | V | A | P | W | I | M | T | P | S | T | L | A | P | 18 | 14404 |
| 15 | A | P | L | E | V | Y | V | C | R | V | R | N | N | T | C | 18 | 14405 |
| 1 | V | F | R | V | A | P | W | I | M | T | P | S | T | L | A | 14 | 14406 |
| 5 | A | P | W | I | M | T | P | S | T | L | A | P | L | E | V | 14 | 14407 |
| 6 | P | W | I | M | T | P | S | T | L | A | P | L | E | V | Y | 14 | 14408 |
| 11 | P | S | T | L | A | P | L | E | V | Y | V | C | R | V | R | 14 | 14409 |
| 8 | I | M | T | P | S | T | L | A | P | L | E | V | Y | V | C | 12 | 14410 |
| 13 | T | L | A | P | L | E | V | Y | V | C | R | V | R | N | N | 12 | 14411 |
| 14 | L | A | P | L | E | V | Y | V | C | R | V | R | N | N | T | 8 | 14412 |
| 3 | R | V | A | P | W | I | M | T | P | S | T | L | A | P | L | 6 | 14413 |
| 9 | M | T | P | S | T | L | A | P | L | E | V | Y | V | C | R | 6 | 14414 |
| 10 | T | P | S | T | L | A | P | L | E | V | Y | V | C | R | V | 6 | 14415 |
| 12 | S | T | L | A | P | L | E | V | Y | V | C | R | V | R | N | 6 | 14416 |

TABLE L-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| | | | | 184P1E2 v.3: HLA Peptide Scoring Results DRB1 0401 15-mers SYFPEITHI | | | | | | | | | | | | | |
| 3 | V | G | H | V | D | E | F | L | S | F | V | P | V | P | D | 20 | 14417 |
| 6 | V | D | E | F | L | S | F | V | P | V | P | D | G | K | G | 16 | 14418 |
| 9 | F | L | S | F | V | P | V | P | D | G | K | G | F | R | M | 16 | 14419 |
| 7 | D | E | F | L | S | F | V | P | V | P | D | G | K | G | F | 14 | 14420 |
| 12 | F | V | P | V | P | D | G | K | G | F | R | M | L | L | A | 14 | 14421 |
| 2 | A | V | G | H | V | D | E | F | L | S | F | V | P | V | P | 12 | 14422 |
| 4 | G | H | V | D | E | F | L | S | F | V | P | V | P | D | G | 12 | 14423 |
| 14 | P | V | P | D | G | K | G | F | R | M | L | L | A | S | P | 12 | 14424 |
| 15 | V | P | D | G | K | G | F | R | M | L | L | A | S | P | G | 12 | 14425 |
| 10 | L | S | F | V | P | V | P | D | G | K | G | F | R | M | L | 8 | 14426 |
| 1 | L | A | V | G | H | V | D | E | F | L | S | F | V | P | V | 6 | 14427 |
| 8 | E | F | L | S | F | V | P | V | P | D | G | K | G | F | R | 6 | 14428 |
| 11 | S | F | V | P | V | P | D | G | K | G | F | R | M | L | L | 6 | 14429 |
| 13 | V | P | V | P | D | G | K | G | F | R | M | L | L | A | S | 1 | 14430 |

TABLE LI

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| | | | | 184P1E2 v.1: HLA Peptide Scoring Results DRB2 1101 15-mers SYFPEITHI | | | | | | | | | | | | | |
| 587 | L | V | N | M | L | V | L | G | K | H | L | G | I | P | K | 28 | 14431 |
| 320 | V | D | A | V | A | E | L | A | R | K | A | G | C | K | L | 26 | 14432 |
| 386 | G | P | D | F | G | Y | V | T | R | E | P | R | D | R | S | 24 | 14433 |
| 389 | F | G | Y | V | T | R | E | P | R | D | R | S | V | S | G | 24 | 14434 |
| 439 | G | R | R | V | T | Q | V | V | R | D | F | L | H | A | Q | 24 | 14435 |
| 446 | V | R | D | F | L | H | A | Q | K | V | Q | P | P | V | E | 24 | 14436 |
| 462 | F | V | D | W | L | A | V | G | H | V | D | E | F | L | S | 24 | 14437 |
| 284 | I | F | T | D | T | V | V | F | R | V | A | P | W | I | M | 23 | 14438 |
| 404 | L | D | S | F | G | N | L | E | V | S | P | P | V | V | A | 22 | 14439 |
| 483 | G | K | G | F | R | M | L | L | A | S | P | G | A | C | F | 22 | 14440 |
| 549 | D | W | N | R | E | V | L | K | R | E | L | G | L | A | E | 22 | 14441 |
| 569 | I | P | Q | L | F | K | T | E | R | K | K | A | T | A | F | 22 | 14442 |
| 354 | L | G | Y | V | Q | A | P | H | K | T | L | P | V | V | F | 21 | 14443 |
| 5 | R | I | V | R | V | S | L | E | H | P | T | S | A | V | C | 20 | 14444 |
| 20 | V | A | G | V | E | T | L | V | D | I | Y | G | S | V | P | 20 | 14445 |
| 71 | D | A | T | L | E | I | I | V | V | M | N | S | P | S | N | 20 | 14446 |
| 148 | G | I | L | L | V | N | C | D | R | D | D | P | S | C | D | 20 | 14447 |
| 178 | E | D | M | S | V | M | V | L | R | T | Q | G | P | A | A | 20 | 14448 |
| 194 | F | D | D | H | K | L | V | L | H | T | S | S | Y | D | A | 20 | 14449 |
| 207 | D | A | K | R | A | Q | V | F | H | I | C | G | P | E | D | 20 | 14450 |
| 233 | D | K | V | S | Y | E | V | P | R | L | H | G | D | E | E | 20 | 14451 |
| 306 | L | E | V | Y | V | C | R | V | R | N | N | T | C | F | V | 20 | 14452 |
| 413 | S | P | P | V | V | A | N | G | K | E | Y | P | L | G | R | 20 | 14453 |
| 566 | I | I | D | I | P | Q | L | F | K | T | E | R | K | K | A | 20 | 14454 |
| 593 | L | G | K | H | L | G | I | P | K | P | F | G | P | I | I | 20 | 14455 |
| 23 | V | E | T | L | V | D | I | Y | G | S | V | P | E | G | T | 19 | 14456 |
| 36 | G | T | E | M | F | E | V | Y | G | T | P | G | V | D | I | 19 | 14457 |
| 73 | T | L | E | I | I | V | V | M | N | S | P | S | N | D | L | 19 | 14458 |
| 179 | D | M | S | V | M | V | L | R | T | Q | G | P | A | A | L | 19 | 14459 |
| 316 | N | T | C | F | V | D | A | V | A | E | L | A | R | K | A | 19 | 14460 |
| 465 | W | L | A | V | G | H | V | D | E | F | L | S | F | V | P | 19 | 14461 |
| 581 | T | A | F | F | P | D | L | V | N | M | L | V | L | G | K | 19 | 14462 |
| 614 | E | E | K | V | R | S | L | L | E | P | L | G | L | H | C | 19 | 14463 |
| 3 | L | Q | R | I | V | R | V | S | L | E | H | P | T | S | A | 18 | 14464 |
| 48 | V | D | I | Y | I | S | P | N | M | E | R | G | R | E | R | 18 | 14465 |
| 246 | E | E | R | F | F | V | E | G | L | S | F | P | D | A | G | 18 | 14466 |
| 248 | R | F | F | V | E | G | L | S | F | P | D | A | G | F | T | 18 | 14467 |
| 258 | D | A | G | F | T | G | L | L | I | S | F | H | V | T | L | 18 | 14468 |
| 353 | E | L | G | Y | V | Q | A | P | H | K | T | L | P | V | V | 18 | 14469 |
| 472 | D | E | F | L | S | F | V | P | A | P | D | G | K | G | F | 18 | 14470 |
| 497 | F | K | L | F | Q | E | K | Q | K | C | G | H | G | R | A | 18 | 14471 |
| 511 | A | L | L | F | Q | G | V | V | D | D | E | Q | V | K | T | 18 | 14472 |
| 570 | P | Q | L | F | K | T | E | R | K | K | A | T | A | F | F | 18 | 14473 |
| 631 | I | D | D | F | T | P | Y | H | M | L | H | G | E | V | H | 18 | 14474 |
| 93 | Q | I | S | Y | H | S | S | H | E | P | L | P | L | A | Y | 17 | 14475 |
| 104 | P | L | A | Y | A | V | L | Y | L | T | C | V | D | I | S | 17 | 14476 |
| 264 | L | I | S | F | H | V | T | L | L | D | D | S | N | E | D | 17 | 14477 |
| 293 | V | A | P | W | I | M | T | P | S | T | L | P | P | L | E | 17 | 14478 |
| 344 | N | D | R | W | I | Q | D | E | M | E | L | G | Y | V | Q | 17 | 14479 |
| 420 | G | K | E | Y | P | L | G | R | I | L | I | G | N | L | 17 | 14480 |
| 474 | F | L | S | F | V | P | A | P | D | G | K | G | F | R | M | 17 | 14481 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 516 | G | V | V | D | D | E | Q | V | K | T | I | S | I | N | Q | 17 | 14482 |
| 610 | C | C | C | L | E | E | K | V | R | S | L | L | E | P | L | 17 | 14483 |
| 634 | F | T | P | Y | H | M | L | H | G | E | V | H | C | G | T | 17 | 14484 |
| 27 | V | D | I | Y | G | S | V | P | E | G | T | E | M | F | E | 16 | 14485 |
| 50 | I | Y | I | S | P | N | M | E | R | G | R | E | R | A | D | 16 | 14486 |
| 52 | I | S | P | N | M | E | R | G | R | E | R | A | D | T | R | 16 | 14487 |
| 61 | E | R | A | D | T | R | R | W | R | F | D | A | T | L | E | 16 | 14488 |
| 136 | K | R | Q | W | V | W | G | P | S | G | Y | G | G | I | L | 16 | 14489 |
| 143 | P | S | G | Y | G | G | I | L | L | V | N | C | D | R | D | 16 | 14490 |
| 177 | L | E | D | M | S | V | M | V | L | R | T | Q | G | P | A | 16 | 14491 |
| 190 | P | A | A | L | F | D | D | H | K | L | V | L | H | T | S | 16 | 14492 |
| 223 | C | E | A | Y | R | H | V | L | G | Q | D | K | V | S | Y | 16 | 14493 |
| 282 | S | P | I | F | T | D | T | V | V | F | R | V | A | P | W | 16 | 14494 |
| 283 | P | I | F | T | D | T | V | V | F | R | V | A | P | W | I | 16 | 14495 |
| 304 | P | P | L | E | V | Y | V | C | R | V | R | N | N | T | C | 16 | 14496 |
| 375 | E | L | Q | D | F | P | Y | K | R | I | L | G | P | D | F | 16 | 14497 |
| 376 | L | Q | D | F | P | Y | K | R | I | L | G | P | D | F | G | 16 | 14498 |
| 378 | D | F | P | Y | K | R | I | L | G | P | D | F | G | Y | V | 16 | 14499 |
| 500 | F | Q | E | K | Q | K | C | G | H | G | R | A | L | L | F | 16 | 14500 |
| 571 | Q | L | F | K | T | E | R | K | K | A | T | A | F | F | P | 16 | 14501 |
| 600 | P | K | P | F | G | P | I | I | N | G | C | C | C | L | E | 16 | 14502 |
| 608 | N | G | C | C | C | L | E | E | K | V | R | S | L | L | E | 16 | 14503 |
| 637 | Y | H | M | L | H | G | E | V | H | C | G | T | N | V | C | 16 | 14504 |
| 644 | V | H | C | G | T | N | V | C | R | K | P | F | S | F | K | 16 | 14505 |
| 109 | V | L | Y | L | T | C | V | D | I | S | L | D | C | D | L | 15 | 14506 |
| 128 | R | Q | D | R | N | F | V | D | K | R | Q | W | V | W | G | 15 | 14507 |
| 219 | P | E | D | V | C | E | A | Y | R | H | V | L | G | Q | D | 15 | 14508 |
| 220 | E | D | V | C | E | A | Y | R | H | V | L | G | Q | D | K | 15 | 14509 |
| 364 | L | P | V | V | F | D | S | P | R | N | G | E | L | Q | D | 15 | 14510 |
| 391 | Y | V | T | R | E | P | R | D | R | S | V | S | G | L | D | 15 | 14511 |
| 419 | N | G | K | E | Y | P | L | G | R | I | L | I | G | G | N | 15 | 14512 |
| 456 | Q | P | P | V | E | L | F | V | D | W | L | A | V | G | H | 15 | 14513 |
| 458 | P | V | E | L | F | V | D | W | L | A | V | G | H | V | D | 15 | 14514 |
| 534 | N | K | D | L | I | N | Y | N | K | F | V | Q | S | C | I | 15 | 14515 |
| 548 | I | D | W | N | R | E | V | L | K | R | E | L | G | L | A | 15 | 14516 |
| 585 | P | D | L | V | N | M | L | V | L | G | K | H | L | G | I | 15 | 14517 |
| 645 | H | C | G | T | N | V | C | R | K | P | F | S | F | K | W | 15 | 14518 |
| 21 | A | G | V | E | T | L | V | D | I | Y | G | S | V | P | E | 14 | 14519 |
| 33 | V | P | E | G | T | E | M | F | E | V | Y | G | T | P | G | 14 | 14520 |
| 72 | A | T | L | E | I | I | V | V | M | N | S | P | S | N | D | 14 | 14521 |
| 89 | D | S | H | V | Q | I | S | Y | H | S | S | H | E | P | L | 14 | 14522 |
| 120 | D | C | D | L | N | C | E | G | R | Q | D | R | N | F | V | 14 | 14523 |
| 146 | Y | G | G | I | L | L | V | N | C | D | R | D | D | P | S | 14 | 14524 |
| 193 | L | F | D | D | H | K | L | V | L | H | T | S | S | Y | D | 14 | 14525 |
| 226 | Y | R | H | V | L | G | Q | D | K | V | S | Y | E | V | P | 14 | 14526 |
| 266 | S | F | H | V | T | L | L | D | D | S | N | E | D | F | S | 14 | 14527 |
| 287 | D | T | V | V | F | R | V | A | P | W | I | M | T | P | S | 14 | 14528 |
| 360 | P | H | K | T | L | P | V | V | F | D | S | P | R | N | G | 14 | 14529 |
| 407 | F | G | N | L | E | V | S | P | P | V | V | A | N | G | K | 14 | 14530 |
| 409 | N | L | E | V | S | P | P | V | V | A | N | G | K | E | Y | 14 | 14531 |
| 443 | T | Q | V | V | R | D | F | L | H | A | Q | K | V | Q | P | 14 | 14532 |
| 547 | C | I | D | W | N | R | E | V | L | K | R | E | L | G | L | 14 | 14533 |
| 588 | V | N | M | L | V | L | G | K | H | L | G | I | P | K | P | 14 | 14534 |
| 625 | G | L | H | C | T | F | I | D | D | F | T | P | Y | H | M | 14 | 14535 |
| 633 | D | F | T | P | Y | H | M | L | H | G | E | V | H | C | G | 14 | 14536 |
| 17 | A | V | C | V | A | G | V | E | T | L | V | D | I | Y | G | 13 | 14537 |
| 42 | V | Y | G | T | P | G | V | D | I | Y | I | S | P | N | M | 13 | 14538 |
| 74 | L | E | I | I | V | V | M | N | S | P | S | N | D | L | N | 13 | 14539 |
| 84 | S | N | D | L | N | D | S | H | V | Q | I | S | Y | H | S | 13 | 14540 |
| 107 | Y | A | V | L | Y | L | T | C | V | D | I | S | L | D | C | 13 | 14541 |
| 174 | L | Q | D | L | E | D | M | S | V | M | V | L | R | T | Q | 13 | 14542 |
| 210 | R | A | Q | V | F | H | I | C | G | P | E | D | V | C | E | 13 | 14543 |
| 229 | V | L | G | Q | D | K | V | S | Y | E | V | P | R | L | H | 13 | 14544 |
| 300 | P | S | T | L | P | P | L | E | V | Y | V | C | R | V | R | 13 | 14545 |
| 361 | H | K | T | L | P | V | V | F | D | S | P | R | N | G | E | 13 | 14546 |
| 363 | T | L | P | V | V | F | D | S | P | R | N | G | E | L | Q | 13 | 14547 |
| 424 | P | L | G | R | I | L | I | G | G | N | L | P | G | S | S | 13 | 14548 |
| 468 | V | G | H | V | D | E | F | L | S | F | V | A | P | D | 13 | 14549 |
| 482 | D | G | K | G | F | R | M | L | L | A | S | P | G | A | C | 13 | 14550 |
| 496 | C | F | K | L | F | Q | E | K | Q | K | C | G | H | G | R | 13 | 14551 |
| 522 | Q | V | K | T | I | S | I | N | Q | V | L | S | N | K | D | 13 | 14552 |
| 525 | T | I | S | I | N | Q | V | L | S | N | K | D | L | I | N | 13 | 14553 |
| 551 | N | R | E | V | L | K | R | E | L | G | L | A | E | C | D | 13 | 14554 |
| 589 | N | M | L | V | L | G | K | H | L | G | I | P | K | P | F | 13 | 14555 |
| 591 | L | V | L | G | K | H | L | G | I | P | K | P | F | G | P | 13 | 14556 |
| 6 | I | V | R | V | S | L | E | H | P | T | S | A | V | C | V | 12 | 14557 |
| 88 | N | D | S | H | V | Q | I | S | Y | H | S | S | H | E | P | 12 | 14558 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 91 | H | V | Q | I | S | Y | H | S | S | H | E | P | L | P | L | 12 | 14559 |
| 97 | H | S | S | H | E | P | L | P | L | A | Y | A | V | L | Y | 12 | 14560 |
| 106 | A | Y | A | V | L | Y | L | T | C | V | D | I | S | L | D | 12 | 14561 |
| 108 | A | V | L | Y | L | T | C | V | D | I | S | L | D | C | D | 12 | 14562 |
| 116 | D | I | S | L | D | C | D | L | N | C | E | G | R | Q | D | 12 | 14563 |
| 131 | R | N | F | V | D | K | R | Q | W | V | W | G | P | S | G | 12 | 14564 |
| 134 | V | D | K | R | Q | W | V | W | G | P | S | G | Y | G | G | 12 | 14565 |
| 137 | R | Q | W | V | W | G | P | S | G | Y | G | G | I | L | L | 12 | 14566 |
| 149 | I | L | L | V | N | C | D | R | D | D | P | S | C | D | V | 12 | 14567 |
| 168 | D | Q | H | V | H | C | L | Q | D | L | E | D | M | S | V | 12 | 14568 |
| 171 | V | H | C | L | Q | D | L | E | D | M | S | V | M | V | L | 12 | 14569 |
| 180 | M | S | V | M | V | L | R | T | Q | G | P | A | A | L | F | 12 | 14570 |
| 181 | S | V | M | V | L | R | T | Q | G | P | A | A | L | F | D | 12 | 14571 |
| 197 | H | K | L | V | L | H | T | S | S | Y | D | A | K | R | A | 12 | 14572 |
| 236 | S | Y | E | V | P | R | L | H | G | D | E | E | R | F | F | 12 | 14573 |
| 269 | V | T | L | L | D | D | S | N | E | D | F | S | A | S | P | 12 | 14574 |
| 290 | V | F | R | V | A | P | W | I | M | T | P | S | T | L | P | 12 | 14575 |
| 294 | A | P | W | I | M | T | P | S | T | L | P | P | L | E | V | 12 | 14576 |
| 307 | E | V | Y | V | C | R | V | R | N | N | T | C | F | V | D | 12 | 14577 |
| 317 | T | C | F | V | D | A | V | A | E | L | A | R | K | A | G | 12 | 14578 |
| 348 | I | Q | D | E | M | E | L | G | Y | V | Q | A | P | H | K | 12 | 14579 |
| 349 | Q | D | E | M | E | L | G | Y | V | Q | A | P | H | K | T | 12 | 14580 |
| 351 | E | M | E | L | G | Y | V | Q | A | P | H | K | T | L | P | 12 | 14581 |
| 379 | F | P | Y | K | R | I | L | G | P | D | F | G | Y | V | T | 12 | 14582 |
| 395 | E | P | R | D | R | S | V | S | G | L | D | S | F | G | N | 12 | 14583 |
| 398 | D | R | S | V | S | G | L | D | S | F | G | N | L | E | V | 12 | 14584 |
| 422 | E | Y | P | L | G | R | I | L | I | G | G | N | L | P | G | 12 | 14585 |
| 425 | L | G | R | I | L | I | G | G | N | L | P | G | S | S | G | 12 | 14586 |
| 426 | G | R | I | L | I | G | G | N | L | P | G | S | S | G | R | 12 | 14587 |
| 427 | R | I | L | I | G | G | N | L | P | G | S | S | G | R | R | 12 | 14588 |
| 428 | I | L | I | G | G | N | L | P | G | S | S | G | R | R | V | 12 | 14589 |
| 447 | R | D | F | L | H | A | Q | K | V | Q | P | P | V | E | L | 12 | 14590 |
| 460 | E | L | F | V | D | W | L | A | V | G | H | V | D | E | F | 12 | 14591 |
| 469 | G | H | V | D | E | F | L | S | F | V | P | A | P | D | G | 12 | 14592 |
| 471 | V | D | E | F | L | S | F | V | P | A | P | D | G | K | G | 12 | 14593 |
| 484 | K | G | F | R | M | L | L | A | S | P | G | A | C | F | K | 12 | 14594 |
| 520 | D | E | Q | V | K | T | I | S | I | N | Q | V | L | S | N | 12 | 14595 |
| 535 | K | D | L | I | N | Y | N | K | F | V | Q | S | C | I | D | 12 | 14596 |
| 537 | L | I | N | Y | N | K | F | V | Q | S | C | I | D | W | N | 12 | 14597 |
| 563 | E | C | D | I | I | D | I | P | Q | L | F | K | T | E | R | 12 | 14598 |
| 584 | F | P | D | L | V | N | M | L | V | L | G | K | H | L | G | 12 | 14599 |
| 594 | G | K | H | L | G | I | P | K | P | F | G | P | I | I | N | 12 | 14600 |
| 618 | R | S | L | L | E | P | L | G | L | H | C | T | F | I | D | 12 | 14601 |
| 636 | P | Y | H | M | L | H | G | E | V | H | C | G | T | N | V | 12 | 14602 |
| 37 | T | E | M | F | E | V | Y | G | T | P | G | V | D | I | Y | 11 | 14603 |
| 40 | F | E | V | Y | G | T | P | G | V | D | I | Y | I | S | P | 11 | 14604 |
| 67 | R | W | R | F | D | A | T | L | E | I | I | V | V | M | N | 11 | 14605 |
| 130 | D | R | N | F | V | D | K | R | Q | W | V | W | G | P | S | 11 | 14606 |
| 164 | Q | D | N | C | D | Q | H | V | H | C | L | Q | D | L | E | 11 | 14607 |
| 191 | A | A | L | F | D | D | H | K | L | V | L | H | T | S | S | 11 | 14608 |
| 203 | T | S | S | Y | D | A | K | R | A | Q | V | F | H | I | C | 11 | 14609 |
| 234 | K | V | S | Y | E | V | P | R | L | H | G | D | E | E | R | 11 | 14610 |
| 288 | T | V | V | F | R | V | A | P | W | I | M | T | P | S | T | 11 | 14611 |
| 303 | L | P | P | L | E | V | Y | V | C | R | V | R | N | N | T | 11 | 14612 |
| 313 | V | R | N | N | T | C | F | V | D | A | V | A | E | L | A | 11 | 14613 |
| 388 | D | F | G | Y | V | T | R | E | P | R | D | R | S | V | S | 11 | 14614 |
| 580 | A | T | A | F | F | P | D | L | V | N | M | L | V | L | G | 11 | 14615 |
| 11 | L | E | H | P | T | S | A | V | C | V | A | G | V | E | T | 10 | 14616 |
| 59 | G | R | E | R | A | D | T | R | R | W | R | F | D | A | T | 10 | 14617 |
| 65 | T | R | R | W | R | F | D | A | T | L | E | I | I | V | V | 10 | 14618 |
| 129 | Q | D | R | N | F | V | D | K | R | Q | W | V | W | G | P | 10 | 14619 |
| 138 | Q | W | V | W | G | P | S | G | Y | G | G | I | L | L | V | 10 | 14620 |
| 211 | A | Q | V | F | H | I | C | G | P | E | D | V | C | E | A | 10 | 14621 |
| 232 | Q | D | K | V | S | Y | E | V | P | R | L | H | G | D | E | 10 | 14622 |
| 247 | E | R | F | F | V | E | G | L | S | F | P | D | A | G | F | 10 | 14623 |
| 253 | G | L | S | F | P | D | A | G | F | T | G | L | I | S | F | 10 | 14624 |
| 276 | N | E | D | F | S | A | S | P | I | F | T | D | T | V | V | 10 | 14625 |
| 359 | A | P | H | K | T | L | P | V | V | F | D | S | P | R | N | 10 | 14626 |
| 365 | P | V | V | F | D | S | P | R | N | G | E | L | Q | D | F | 10 | 14627 |
| 374 | G | E | L | Q | D | F | P | Y | K | R | I | L | G | P | D | 10 | 14628 |
| 385 | L | G | P | D | F | G | Y | V | T | R | E | P | R | D | R | 10 | 14629 |
| 432 | G | N | L | P | G | S | S | G | R | R | V | T | Q | V | V | 10 | 14630 |
| 459 | V | E | L | F | V | D | W | L | A | V | G | H | V | D | E | 10 | 14631 |
| 494 | G | A | C | F | K | L | F | Q | E | K | Q | K | C | G | H | 10 | 14632 |
| 540 | Y | N | K | F | V | Q | S | C | I | D | W | N | R | E | V | 10 | 14633 |
| 627 | H | C | T | F | I | D | D | F | T | P | Y | H | M | L | H | 10 | 14634 |
| 630 | F | I | D | D | F | T | P | Y | H | M | L | H | G | E | V | 10 | 14635 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 643 | E | V | H | C | G | T | N | V | C | R | K | P | F | S | F | 10 | 14636 |
| 58 | R | G | R | E | R | A | D | T | R | R | W | R | F | D | A | 9 | 14637 |
| 102 | P | L | P | L | A | Y | A | V | L | Y | L | T | C | V | D | 9 | 14638 |
| 189 | G | P | A | A | L | F | D | D | H | K | L | V | L | H | T | 9 | 14639 |
| 201 | L | H | T | S | S | Y | D | A | K | R | A | Q | V | F | H | 9 | 14640 |
| 244 | G | D | E | E | R | F | F | V | E | G | L | S | F | P | D | 9 | 14641 |
| 262 | T | G | L | I | S | F | H | V | T | L | L | D | D | S | N | 9 | 14642 |
| 338 | P | Q | A | E | N | R | N | D | R | W | I | Q | D | E | M | 9 | 14643 |
| 431 | G | G | N | L | P | G | S | S | G | R | R | V | T | Q | V | 9 | 14644 |
| 479 | P | A | P | D | G | K | G | F | R | M | L | L | A | S | P | 9 | 14645 |
| 495 | A | C | F | K | L | F | Q | E | K | Q | K | C | G | H | G | 9 | 14646 |
| 502 | E | K | Q | K | C | G | H | G | R | A | L | L | F | Q | G | 9 | 14647 |
| 510 | R | A | L | L | F | Q | G | V | V | D | D | E | Q | V | K | 9 | 14648 |
| 527 | S | I | N | Q | V | L | S | N | K | D | L | I | N | Y | N | 9 | 14649 |
| 544 | V | Q | S | C | I | D | W | N | R | E | V | L | K | R | E | 9 | 14650 |
| 26 | L | V | D | I | Y | G | S | V | P | E | G | T | E | M | F | 8 | 14651 |
| 35 | E | G | T | E | M | F | E | V | Y | G | T | P | G | V | D | 8 | 14652 |
| 54 | P | N | M | E | R | G | R | E | R | A | D | T | R | R | W | 8 | 14653 |
| 83 | P | S | N | D | L | N | D | S | H | V | Q | I | S | Y | H | 8 | 14654 |
| 92 | V | Q | I | S | Y | H | S | S | H | E | P | L | P | L | A | 8 | 14655 |
| 123 | L | N | C | E | G | R | Q | D | R | N | F | V | D | K | R | 8 | 14656 |
| 133 | F | V | D | K | R | Q | W | V | W | G | P | S | G | Y | G | 8 | 14657 |
| 145 | G | Y | G | G | I | L | L | V | N | C | D | R | D | D | P | 8 | 14658 |
| 147 | G | G | I | L | L | V | N | C | D | R | D | D | P | S | C | 8 | 14659 |
| 162 | D | V | Q | D | N | C | D | Q | H | V | H | C | L | Q | D | 8 | 14660 |
| 176 | D | L | E | D | M | S | V | M | V | L | R | T | Q | G | P | 8 | 14661 |
| 200 | V | L | H | T | S | S | Y | D | A | K | R | A | Q | V | F | 8 | 14662 |
| 202 | H | T | S | S | Y | D | A | K | R | A | Q | V | F | H | I | 8 | 14663 |
| 224 | E | A | Y | R | H | V | L | G | Q | D | K | V | S | Y | E | 8 | 14664 |
| 235 | V | S | Y | E | V | P | R | L | H | G | D | E | E | R | F | 8 | 14665 |
| 240 | P | R | L | H | G | D | E | E | R | F | F | V | E | G | L | 8 | 14666 |
| 260 | G | F | T | G | L | I | S | F | H | V | T | L | L | D | D | 8 | 14667 |
| 286 | T | D | T | V | V | F | R | V | A | P | W | I | M | T | P | 8 | 14668 |
| 295 | P | W | I | M | T | P | S | T | L | P | P | L | E | V | Y | 8 | 14669 |
| 302 | T | L | P | P | L | E | V | Y | V | C | R | V | R | N | N | 8 | 14670 |
| 305 | P | L | E | V | Y | V | C | R | V | R | N | N | T | C | F | 8 | 14671 |
| 319 | F | V | D | A | V | A | E | L | A | R | K | A | G | C | K | 8 | 14672 |
| 321 | D | A | V | A | E | L | A | R | K | A | G | C | K | L | T | 8 | 14673 |
| 325 | E | L | A | R | K | A | G | C | K | L | T | I | C | P | Q | 8 | 14674 |
| 331 | G | C | K | L | T | I | C | P | Q | A | E | N | R | N | D | 8 | 14675 |
| 333 | K | L | T | I | C | P | Q | A | E | N | R | N | D | R | W | 8 | 14676 |
| 335 | T | I | C | P | Q | A | E | N | R | N | D | R | W | I | Q | 8 | 14677 |
| 373 | N | G | E | L | Q | D | F | P | Y | K | R | I | L | G | P | 8 | 14678 |
| 410 | L | E | V | S | P | P | V | V | A | N | G | K | E | Y | P | 8 | 14679 |
| 411 | E | V | S | P | P | V | V | A | N | G | K | E | Y | P | L | 8 | 14680 |
| 433 | N | L | P | G | S | S | G | R | R | V | T | Q | V | V | R | 8 | 14681 |
| 440 | R | R | V | T | Q | V | V | R | D | F | L | H | A | Q | K | 8 | 14682 |
| 452 | A | Q | K | V | Q | P | P | V | E | L | F | V | D | W | L | 8 | 14683 |
| 476 | S | F | V | P | A | P | D | G | K | G | F | R | M | L | L | 8 | 14684 |
| 490 | L | A | S | P | G | A | C | F | K | L | F | Q | E | K | Q | 8 | 14685 |
| 493 | P | G | A | C | F | K | L | F | Q | E | K | Q | K | C | G | 8 | 14686 |
| 542 | K | F | V | Q | S | C | I | D | W | N | R | E | V | L | K | 8 | 14687 |
| 583 | F | F | P | D | L | V | N | M | L | V | L | G | K | H | L | 8 | 14688 |
| 619 | S | L | L | E | P | L | G | L | H | C | T | F | I | D | D | 8 | 14689 |
| 650 | V | C | R | K | P | F | S | F | K | W | W | N | M | V | P | 8 | 14690 |
| 1 | M | S | L | Q | R | I | V | R | V | S | L | E | H | P | T | 7 | 14691 |
| 4 | Q | R | I | V | R | V | S | L | E | H | P | T | S | A | V | 7 | 14692 |
| 8 | R | V | S | L | E | H | P | T | S | A | V | C | V | A | G | 7 | 14693 |
| 10 | S | L | E | H | P | T | S | A | V | C | V | A | G | V | E | 7 | 14694 |
| 15 | T | S | A | V | C | V | A | G | V | E | T | L | V | D | I | 7 | 14695 |
| 43 | Y | G | T | P | G | V | D | I | Y | I | S | P | N | M | E | 7 | 14696 |
| 49 | D | I | Y | I | S | P | N | M | E | R | G | R | E | R | A | 7 | 14697 |
| 53 | S | P | N | M | E | R | G | R | E | R | A | D | T | R | R | 7 | 14698 |
| 68 | W | R | F | D | A | T | L | E | I | V | V | M | N | S | H | 7 | 14699 |
| 77 | I | V | V | M | N | S | P | S | N | D | L | N | D | S | H | 7 | 14700 |
| 87 | L | N | D | S | H | V | Q | I | S | Y | H | S | S | H | E | 7 | 14701 |
| 95 | S | Y | H | S | S | H | E | P | L | P | L | A | Y | A | V | 7 | 14702 |
| 99 | S | H | E | P | L | P | L | A | Y | A | V | L | Y | L | T | 7 | 14703 |
| 100 | H | E | P | L | P | L | A | Y | A | V | L | Y | L | T | C | 7 | 14704 |
| 113 | T | C | V | D | I | S | L | D | C | D | L | N | C | E | G | 7 | 14705 |
| 195 | D | D | H | K | L | V | L | H | T | S | S | Y | D | A | K | 7 | 14706 |
| 208 | A | K | R | A | Q | V | F | H | I | C | G | P | E | D | V | 7 | 14707 |
| 225 | A | Y | R | H | V | L | G | Q | D | K | V | S | Y | E | V | 7 | 14708 |
| 239 | V | P | R | L | H | G | D | E | E | R | F | F | V | E | G | 7 | 14709 |
| 245 | D | E | E | R | F | F | V | E | G | L | S | F | P | D | A | 7 | 14710 |
| 252 | E | G | L | S | F | P | D | A | G | F | T | G | L | I | S | 7 | 14711 |
| 255 | S | F | P | D | A | G | F | T | G | L | I | S | F | H | V | 7 | 14712 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 259 | A | G | F | T | G | L | I | S | F | H | V | T | L | L | D | 7 | 14713 |
| 261 | F | T | G | L | I | S | F | H | V | T | L | L | D | D | S | 7 | 14714 |
| 263 | G | L | I | S | F | H | V | T | L | L | D | D | S | N | E | 7 | 14715 |
| 281 | A | S | P | I | F | T | D | T | V | V | F | R | V | A | P | 7 | 14716 |
| 310 | V | C | R | V | R | N | N | T | C | F | V | D | A | V | A | 7 | 14717 |
| 323 | V | A | E | L | A | R | K | A | G | C | K | L | T | I | C | 7 | 14718 |
| 382 | K | R | I | L | G | P | D | F | G | Y | V | T | R | E | P | 7 | 14719 |
| 402 | S | G | L | D | S | F | G | N | L | E | V | S | P | P | V | 7 | 14720 |
| 403 | G | L | D | S | F | G | N | L | E | V | S | P | P | V | V | 7 | 14721 |
| 406 | S | F | G | N | L | E | V | S | P | P | V | V | A | N | G | 7 | 14722 |
| 415 | P | V | V | A | N | G | K | E | Y | P | L | G | R | I | L | 7 | 14723 |
| 436 | G | S | S | G | R | R | V | T | Q | V | V | R | D | F | L | 7 | 14724 |
| 441 | R | V | T | Q | V | V | R | D | F | L | H | A | Q | K | V | 7 | 14725 |
| 444 | Q | V | V | R | D | F | L | H | A | Q | K | V | Q | P | P | 7 | 14726 |
| 449 | F | L | H | A | Q | K | V | Q | P | P | V | E | L | F | V | 7 | 14727 |
| 453 | Q | K | V | Q | P | P | V | E | L | F | V | D | W | L | A | 7 | 14728 |
| 463 | V | D | W | L | A | V | G | H | V | D | E | F | L | S | F | 7 | 14729 |
| 470 | H | V | D | E | F | L | S | F | V | P | A | P | D | G | K | 7 | 14730 |
| 480 | A | P | D | G | K | G | F | R | M | L | L | A | S | P | G | 7 | 14731 |
| 507 | G | H | G | R | A | L | L | F | Q | G | V | V | D | D | E | 7 | 14732 |
| 512 | L | L | F | Q | G | V | V | D | D | E | Q | V | K | T | I | 7 | 14733 |
| 514 | F | Q | G | V | V | D | D | E | Q | V | K | T | I | S | I | 7 | 14734 |
| 526 | I | S | I | N | Q | V | L | S | N | K | D | L | I | N | Y | 7 | 14735 |
| 528 | I | N | Q | V | L | S | N | K | D | L | I | N | Y | N | K | 7 | 14736 |
| 532 | L | S | N | K | D | L | I | N | Y | N | K | F | V | Q | S | 7 | 14737 |
| 538 | I | N | Y | N | K | F | V | Q | S | C | I | D | W | N | R | 7 | 14738 |
| 545 | Q | S | C | I | D | W | N | R | E | V | L | K | R | E | L | 7 | 14739 |
| 556 | K | R | E | L | G | L | A | E | C | D | I | I | D | I | P | 7 | 14740 |
| 559 | L | G | L | A | E | C | D | I | I | D | I | P | Q | L | F | 7 | 14741 |
| 564 | C | D | I | I | D | I | P | Q | L | F | K | T | E | R | K | 7 | 14742 |
| 582 | A | F | F | P | D | L | V | N | M | L | V | L | G | K | H | 7 | 14743 |
| 596 | H | L | G | I | P | K | P | F | G | P | I | I | N | G | C | 7 | 14744 |
| 603 | F | G | P | I | I | N | G | C | C | C | L | E | E | K | V | 7 | 14745 |
| 607 | I | N | G | C | C | C | L | E | E | K | V | R | S | L | L | 7 | 14746 |
| 611 | C | C | L | E | E | K | V | R | S | L | L | E | P | L | G | 7 | 14747 |
| 612 | C | L | E | E | K | V | R | S | L | L | E | P | L | G | L | 7 | 14748 |
| 621 | L | E | P | L | G | L | H | C | T | F | I | D | D | F | T | 7 | 14749 |
| 12 | E | H | P | T | S | A | V | C | V | A | G | V | E | T | L | 6 | 14750 |
| 14 | P | T | S | A | V | C | V | A | G | V | E | T | L | V | D | 6 | 14751 |
| 24 | E | T | L | V | D | I | Y | G | S | V | P | E | G | T | E | 6 | 14752 |
| 25 | T | L | V | D | I | Y | G | S | V | P | E | G | T | E | M | 6 | 14753 |
| 30 | Y | G | S | V | P | E | G | T | E | M | F | E | V | Y | G | 6 | 14754 |
| 39 | M | F | E | V | Y | G | T | P | G | V | D | I | Y | I | S | 6 | 14755 |
| 44 | G | T | P | G | V | D | I | Y | I | S | P | N | M | E | R | 6 | 14756 |
| 45 | T | P | G | V | D | I | Y | I | S | P | N | M | E | R | G | 6 | 14757 |
| 46 | P | G | V | D | I | Y | I | S | P | N | M | E | R | G | R | 6 | 14758 |
| 47 | G | V | D | I | Y | I | S | P | N | M | E | R | G | R | E | 6 | 14759 |
| 70 | F | D | A | T | L | E | I | I | V | V | M | N | S | P | S | 6 | 14760 |
| 75 | E | I | I | V | V | M | N | S | P | S | N | D | L | N | D | 6 | 14761 |
| 76 | I | I | V | V | M | N | S | P | S | N | D | L | N | D | S | 6 | 14762 |
| 79 | V | M | N | S | P | S | N | D | L | N | D | S | H | V | Q | 6 | 14763 |
| 81 | N | S | P | S | N | D | L | N | D | S | H | V | Q | I | S | 6 | 14764 |
| 86 | D | L | N | D | S | H | V | Q | I | S | Y | H | S | S | H | 6 | 14765 |
| 103 | L | P | L | A | Y | A | V | L | Y | L | T | C | V | D | I | 6 | 14766 |
| 111 | Y | L | T | C | V | D | I | S | L | D | C | D | L | N | C | 6 | 14767 |
| 112 | L | T | C | V | D | I | S | L | D | C | D | L | N | C | E | 6 | 14768 |
| 114 | C | V | D | I | S | L | D | C | D | L | N | C | E | G | R | 6 | 14769 |
| 117 | I | S | L | D | C | D | L | N | C | E | G | R | Q | D | R | 6 | 14770 |
| 132 | N | F | V | D | K | R | Q | W | V | W | G | P | S | G | Y | 6 | 14771 |
| 144 | S | G | Y | G | G | I | L | L | V | N | C | D | R | D | D | 6 | 14772 |
| 157 | D | D | P | S | C | D | V | Q | D | N | C | D | Q | H | V | 6 | 14773 |
| 160 | S | C | D | V | Q | D | N | C | D | Q | H | V | H | C | L | 6 | 14774 |
| 165 | D | N | C | D | Q | H | V | H | C | L | Q | D | L | E | D | 6 | 14775 |
| 170 | H | V | H | C | L | Q | D | L | E | D | M | S | V | M | V | 6 | 14776 |
| 182 | V | M | V | L | R | T | Q | G | P | A | L | F | D | D | D | 6 | 14777 |
| 187 | T | Q | G | P | A | A | L | F | D | D | H | K | L | V | L | 6 | 14778 |
| 196 | D | H | K | L | V | L | H | T | S | S | Y | D | A | K | R | 6 | 14779 |
| 198 | K | L | V | L | H | T | S | S | Y | D | A | K | R | A | Q | 6 | 14780 |
| 213 | V | F | H | I | C | G | P | E | D | V | C | E | A | Y | R | 6 | 14781 |
| 214 | F | H | I | C | G | P | E | D | V | C | E | A | Y | R | H | 6 | 14782 |
| 216 | I | C | G | P | E | D | V | C | E | A | Y | R | H | V | L | 6 | 14783 |
| 227 | R | H | V | L | G | Q | D | K | V | S | Y | E | V | P | R | 6 | 14784 |
| 242 | L | H | G | D | E | E | R | F | F | V | E | G | L | S | F | 6 | 14785 |
| 249 | F | F | V | E | G | L | S | F | P | D | A | G | F | T | G | 6 | 14786 |
| 251 | V | E | G | L | S | F | P | D | A | G | F | T | G | L | I | 6 | 14787 |
| 265 | I | S | F | H | V | T | L | L | D | D | S | N | E | D | F | 6 | 14788 |
| 268 | H | V | T | L | L | D | D | S | N | E | D | F | S | A | S | 6 | 14789 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 270 | T | L | L | D | D | S | N | E | D | F | S | A | S | P | I | 6 | 14790 |
| 271 | L | L | D | D | S | N | E | D | F | S | A | S | P | I | F | 6 | 14791 |
| 272 | L | D | D | S | N | E | D | F | S | A | S | P | I | F | T | 6 | 14792 |
| 278 | D | F | S | A | S | P | I | F | T | D | T | V | V | F | R | 6 | 14793 |
| 289 | V | V | F | R | V | A | P | W | I | M | T | P | S | T | L | 6 | 14794 |
| 291 | F | R | V | A | P | W | I | M | T | P | S | T | L | P | P | 6 | 14795 |
| 292 | R | V | A | P | W | I | M | T | P | S | T | L | P | P | L | 6 | 14796 |
| 297 | I | M | T | P | S | T | L | P | P | L | E | V | Y | V | C | 6 | 14797 |
| 311 | C | R | V | R | N | N | T | C | F | V | D | A | V | A | E | 6 | 14798 |
| 314 | R | N | N | T | C | F | V | D | A | V | A | E | L | A | R | 6 | 14799 |
| 327 | A | R | K | A | G | C | K | L | T | I | C | P | Q | A | E | 6 | 14800 |
| 328 | R | K | A | G | C | K | L | T | I | C | P | Q | A | E | N | 6 | 14801 |
| 329 | K | A | G | C | K | L | T | I | C | P | Q | A | E | N | R | 6 | 14802 |
| 330 | A | G | C | K | L | T | I | C | P | Q | A | E | N | R | N | 6 | 14803 |
| 342 | N | R | N | D | R | W | I | Q | D | E | M | E | L | G | Y | 6 | 14804 |
| 345 | D | R | W | I | Q | D | E | M | E | L | G | Y | V | Q | A | 6 | 14805 |
| 346 | R | W | I | Q | D | E | M | E | L | G | Y | V | Q | A | P | 6 | 14806 |
| 358 | Q | A | P | H | K | T | L | P | V | V | F | D | S | P | R | 6 | 14807 |
| 369 | D | S | P | R | N | G | E | L | Q | D | F | P | Y | K | R | 6 | 14808 |
| 370 | S | P | R | N | G | E | L | Q | D | F | P | Y | K | R | I | 6 | 14809 |
| 381 | Y | K | R | I | L | G | P | D | F | G | Y | V | T | R | E | 6 | 14810 |
| 392 | V | T | R | E | P | R | D | R | S | V | S | G | L | D | S | 6 | 14811 |
| 397 | R | D | R | S | V | S | G | L | D | S | F | G | N | L | E | 6 | 14812 |
| 401 | V | S | G | L | D | S | F | G | N | L | E | V | S | P | P | 6 | 14813 |
| 414 | P | P | V | V | A | N | G | K | E | Y | P | L | G | R | I | 6 | 14814 |
| 421 | K | E | Y | P | L | G | R | I | L | I | G | G | N | L | P | 6 | 14815 |
| 423 | Y | P | L | G | R | I | L | I | G | G | N | L | P | G | S | 6 | 14816 |
| 442 | V | T | Q | V | V | R | D | F | L | H | A | Q | K | V | Q | 6 | 14817 |
| 455 | V | Q | P | P | V | E | L | F | V | D | W | L | A | V | G | 6 | 14818 |
| 457 | P | P | V | E | L | F | V | D | W | L | A | V | G | H | V | 6 | 14819 |
| 475 | L | S | F | V | P | A | P | D | G | K | G | F | R | M | L | 6 | 14820 |
| 481 | P | D | G | K | G | F | R | M | L | L | A | S | P | G | A | 6 | 14821 |
| 485 | G | F | R | M | L | L | A | S | P | G | A | C | F | K | L | 6 | 14822 |
| 486 | F | R | M | L | L | A | S | P | G | A | C | F | K | L | F | 6 | 14823 |
| 487 | R | M | L | L | A | S | P | G | A | C | F | K | L | F | Q | 6 | 14824 |
| 498 | K | L | F | Q | E | K | Q | K | C | G | H | G | R | A | L | 6 | 14825 |
| 505 | K | C | G | H | G | R | A | L | L | F | Q | G | V | V | D | 6 | 14826 |
| 506 | C | G | H | G | R | A | L | L | F | Q | G | V | V | D | D | 6 | 14827 |
| 509 | G | R | A | L | L | F | Q | G | V | V | D | D | E | Q | V | 6 | 14828 |
| 515 | Q | G | V | V | D | D | E | Q | V | K | T | I | S | I | N | 6 | 14829 |
| 517 | V | V | D | D | E | Q | V | K | T | I | S | I | N | Q | V | 6 | 14830 |
| 523 | V | K | T | I | S | I | N | Q | V | L | S | N | K | D | L | 6 | 14831 |
| 529 | N | Q | V | L | S | N | K | D | L | I | N | Y | N | K | F | 6 | 14832 |
| 531 | V | L | S | N | K | D | L | I | N | Y | N | K | F | V | Q | 6 | 14833 |
| 541 | N | K | F | V | Q | S | C | I | D | W | N | R | E | V | L | 6 | 14834 |
| 552 | R | E | V | L | K | R | E | L | G | L | A | E | C | D | I | 6 | 14835 |
| 553 | E | V | L | K | R | E | L | G | L | A | E | C | D | I | I | 6 | 14836 |
| 555 | L | K | R | E | L | G | L | A | E | C | D | I | I | D | I | 6 | 14837 |
| 558 | E | L | G | L | A | E | C | D | I | I | D | I | P | Q | L | 6 | 14838 |
| 560 | G | L | A | E | C | D | I | I | D | I | P | Q | L | F | K | 6 | 14839 |
| 561 | L | A | E | C | D | I | I | D | I | P | Q | L | F | K | T | 6 | 14840 |
| 574 | K | T | E | R | K | K | A | T | A | F | F | P | D | L | V | 6 | 14841 |
| 586 | D | L | V | N | M | L | V | L | G | K | H | L | G | I | P | 6 | 14842 |
| 590 | M | L | V | L | G | K | H | L | G | I | P | K | P | F | G | 6 | 14843 |
| 598 | G | I | P | K | P | F | G | P | I | I | N | G | C | C | C | 6 | 14844 |
| 601 | K | P | F | G | P | I | I | N | G | C | C | C | L | E | E | 6 | 14845 |
| 604 | G | P | I | I | N | G | C | C | C | L | E | E | K | V | R | 6 | 14846 |
| 615 | E | K | V | R | S | L | L | E | P | L | G | L | H | C | T | 6 | 14847 |
| 617 | V | R | S | L | L | E | P | L | G | L | H | C | T | F | I | 6 | 14848 |
| 620 | L | L | E | P | L | G | L | H | C | T | F | I | D | D | F | 6 | 14849 |
| 623 | P | L | G | L | H | C | T | F | I | D | D | F | T | P | Y | 6 | 14850 |
| 628 | C | T | F | I | D | D | F | T | P | Y | H | M | L | H | G | 6 | 14851 |
| 638 | H | M | L | H | G | E | V | H | C | G | T | N | V | C | R | 6 | 14852 |
| 641 | H | G | E | V | H | C | G | T | N | V | C | R | K | P | F | 6 | 14853 |
| 647 | G | T | N | V | C | R | K | P | F | S | F | K | W | W | N | 6 | 14854 |
| 13 | H | P | T | S | A | V | C | V | A | G | V | E | T | L | V | 4 | 14855 |
| 41 | E | V | Y | G | T | P | G | V | D | I | Y | I | S | P | N | 4 | 14856 |
| 127 | G | R | Q | D | R | N | F | V | D | K | R | Q | W | V | W | 4 | 14857 |
| 2 | S | L | Q | R | I | V | R | V | S | L | E | H | P | T | S | 3 | 14858 |
| 16 | S | A | V | C | V | A | G | V | E | T | L | V | D | I | Y | 3 | 14859 |
| 57 | E | R | G | R | E | R | A | D | T | R | R | W | R | F | D | 3 | 14860 |
| 69 | R | F | D | A | T | L | E | I | I | V | V | M | N | S | P | 3 | 14861 |
| 175 | Q | D | L | E | D | M | S | V | M | V | L | R | T | Q | G | 3 | 14862 |
| 183 | M | V | L | R | T | Q | G | P | A | A | L | F | D | D | H | 3 | 14863 |
| 199 | L | V | L | H | T | S | S | Y | D | A | K | R | A | Q | V | 3 | 14864 |
| 206 | Y | D | A | K | R | A | Q | V | F | H | I | C | G | P | E | 3 | 14865 |
| 217 | C | G | P | E | D | V | C | E | A | Y | R | H | V | L | G | 3 | 14866 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 298 | M | T | P | S | T | L | P | P | L | E | V | Y | V | C | R | 3 | 14867 |
| 318 | C | F | V | D | A | V | A | E | L | A | R | K | A | G | C | 3 | 14868 |
| 362 | K | T | L | P | V | V | F | D | S | P | R | N | G | E | L | 3 | 14869 |
| 387 | P | D | F | G | Y | V | T | R | E | P | R | D | R | S | V | 3 | 14870 |
| 394 | R | E | P | R | D | R | S | V | S | G | L | D | S | F | G | 3 | 14871 |
| 435 | P | G | S | S | G | R | R | V | T | Q | V | R | D | F | 3 | | 14872 |
| 437 | S | S | G | R | R | V | T | Q | V | V | R | D | F | L | H | 3 | 14873 |
| 438 | S | G | R | R | V | T | Q | V | V | R | D | F | L | H | A | 3 | 14874 |
| 461 | L | F | V | D | W | L | A | V | G | H | V | D | E | F | L | 3 | 14875 |
| 521 | E | Q | V | K | T | I | S | I | N | Q | V | L | S | N | K | 3 | 14876 |
| 577 | R | K | K | A | T | A | F | F | P | D | L | V | N | M | L | 3 | 14877 |
| 56 | M | E | R | G | R | E | R | A | D | T | R | R | W | R | F | 2 | 14878 |
| 66 | R | R | W | R | F | D | A | T | L | E | I | I | V | V | M | 2 | 14879 |
| 85 | N | D | L | N | D | S | H | V | Q | I | S | Y | H | S | S | 2 | 14880 |
| 118 | S | L | D | C | D | L | N | C | E | G | R | Q | D | R | N | 2 | 14881 |
| 121 | C | D | L | N | C | E | G | R | Q | D | R | N | F | V | D | 2 | 14882 |
| 156 | R | D | D | P | S | C | D | V | Q | D | N | C | D | Q | H | 2 | 14883 |
| 215 | H | I | C | G | P | E | D | V | C | E | A | Y | R | H | V | 2 | 14884 |
| 222 | V | C | E | A | Y | R | H | V | L | G | Q | D | K | V | S | 2 | 14885 |
| 228 | H | V | L | G | Q | D | K | V | S | Y | E | V | P | R | L | 2 | 14886 |
| 231 | G | Q | D | K | V | S | Y | E | V | P | R | L | H | G | D | 2 | 14887 |
| 238 | E | V | P | R | L | H | G | D | E | E | R | F | F | V | E | 2 | 14888 |
| 301 | S | T | L | P | P | L | E | V | Y | V | C | R | V | R | N | 2 | 14889 |
| 315 | N | N | T | C | F | V | D | A | V | A | E | L | A | R | K | 2 | 14890 |
| 336 | I | C | P | Q | A | E | N | R | N | D | R | W | I | Q | D | 2 | 14891 |
| 350 | D | E | M | E | L | G | Y | V | Q | A | P | H | K | T | L | 2 | 14892 |
| 352 | M | E | L | G | Y | V | Q | A | P | H | K | T | L | P | V | 2 | 14893 |
| 384 | I | L | G | P | D | F | G | Y | V | T | R | E | P | R | D | 2 | 14894 |
| 405 | D | S | F | Q | N | L | E | V | S | P | P | V | V | A | N | 2 | 14895 |
| 417 | V | A | N | G | K | E | Y | P | L | G | R | I | L | I | G | 2 | 14896 |
| 418 | A | N | G | K | E | Y | P | L | G | R | I | L | I | G | G | 2 | 14897 |
| 430 | I | G | G | N | L | P | G | S | S | G | R | R | V | T | Q | 2 | 14898 |
| 445 | V | V | R | D | F | L | H | A | Q | K | V | Q | P | P | V | 2 | 14899 |
| 448 | D | F | L | H | A | Q | K | V | Q | P | P | V | E | L | F | 2 | 14900 |
| 464 | D | W | L | A | V | G | H | V | D | E | F | L | S | F | V | 2 | 14901 |
| 473 | E | F | L | S | F | V | P | A | P | D | G | K | G | F | R | 2 | 14902 |
| 477 | P | V | P | A | P | D | G | K | G | F | R | M | L | L | A | 2 | 14903 |
| 513 | L | F | Q | G | V | V | D | D | E | Q | V | K | T | I | S | 2 | 14904 |
| 518 | V | D | D | E | Q | V | K | T | I | S | I | N | Q | V | L | 2 | 14905 |
| 524 | K | T | I | S | I | N | Q | V | L | S | N | K | D | L | I | 2 | 14906 |
| 539 | N | Y | N | K | F | V | Q | S | C | I | D | W | N | R | E | 2 | 14907 |
| 567 | I | D | I | P | Q | L | F | K | T | E | R | K | K | A | T | 2 | 14908 |
| 568 | D | I | P | Q | L | F | K | T | E | R | K | K | A | T | A | 2 | 14909 |
| 642 | G | E | V | H | C | G | T | N | V | C | R | K | P | F | S | 2 | 14910 |
| 18 | V | C | V | A | G | V | E | T | L | V | D | I | Y | G | S | 1 | 14911 |
| 19 | C | V | A | G | V | E | T | L | V | D | I | Y | G | S | V | 1 | 14912 |
| 22 | G | V | E | T | L | V | D | I | Y | G | S | V | P | E | G | 1 | 14913 |
| 28 | D | I | Y | G | S | V | P | E | G | T | E | M | F | E | V | 1 | 14914 |
| 32 | S | V | P | E | G | T | E | M | F | E | V | Y | G | T | P | 1 | 14915 |
| 38 | E | M | F | E | V | Y | G | T | P | G | V | D | I | Y | I | 1 | 14916 |
| 51 | Y | I | S | P | N | M | E | R | G | R | E | R | A | D | T | 1 | 14917 |
| 60 | R | E | R | A | D | T | R | R | W | R | F | D | A | T | L | 1 | 14918 |
| 64 | D | T | R | R | W | R | F | D | A | T | L | E | I | I | V | 1 | 14919 |
| 82 | S | P | S | N | D | L | N | D | S | H | V | Q | I | S | Y | 1 | 14920 |
| 105 | L | A | Y | A | V | L | Y | L | T | C | V | D | I | S | L | 1 | 14921 |
| 110 | L | Y | L | T | C | V | D | I | S | L | D | C | D | L | N | 1 | 14922 |
| 119 | L | D | C | D | L | N | C | E | G | R | Q | D | R | N | F | 1 | 14923 |
| 122 | D | L | N | C | E | G | R | Q | D | R | N | F | V | D | K | 1 | 14924 |
| 124 | N | C | E | G | R | Q | D | R | N | F | V | D | K | R | Q | 1 | 14925 |
| 126 | E | G | R | Q | D | R | N | F | V | D | K | R | Q | W | V | 1 | 14926 |
| 135 | D | K | R | Q | W | V | W | G | P | S | G | Y | G | G | I | 1 | 14927 |
| 139 | W | V | W | G | P | S | G | Y | G | G | I | L | L | V | N | 1 | 14928 |
| 140 | V | W | G | P | S | G | Y | G | G | I | L | L | V | N | C | 1 | 14929 |
| 141 | W | G | P | S | G | Y | G | G | I | L | L | V | N | C | D | 1 | 14930 |
| 142 | G | P | S | G | Y | G | G | I | L | L | V | N | C | D | R | 1 | 14931 |
| 153 | N | C | D | R | D | D | P | S | C | D | V | Q | D | N | C | 1 | 14932 |
| 158 | D | P | S | C | D | V | Q | D | N | C | D | Q | H | V | H | 1 | 14933 |
| 161 | C | D | V | Q | D | N | C | D | Q | H | V | H | C | L | Q | 1 | 14934 |
| 166 | N | C | D | Q | H | V | H | C | L | Q | D | L | E | D | M | 1 | 14935 |
| 167 | C | D | Q | H | V | H | C | L | Q | D | L | E | D | M | S | 1 | 14936 |
| 172 | H | C | L | Q | D | L | E | D | M | S | V | M | V | L | R | 1 | 14937 |
| 188 | Q | G | P | A | L | F | D | D | H | K | L | V | L | H | 1 | | 14938 |
| 212 | Q | V | F | H | I | C | G | P | E | D | V | C | E | A | Y | 1 | 14939 |
| 218 | G | P | E | D | V | C | E | A | Y | R | H | V | L | G | Q | 1 | 14940 |
| 230 | L | G | Q | D | K | V | S | Y | E | V | P | R | L | H | G | 1 | 14941 |
| 241 | R | L | H | G | D | E | E | R | F | F | V | E | G | L | S | 1 | 14942 |
| 254 | L | S | F | P | D | A | G | F | T | G | L | I | S | F | H | 1 | 14943 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 257 | P | D | A | G | F | T | G | L | I | S | F | H | V | T | L | 1 | 14944 |
| 274 | D | S | N | E | D | F | S | A | S | P | I | F | T | D | T | 1 | 14945 |
| 275 | S | N | E | D | F | S | A | S | P | I | F | T | D | T | V | 1 | 14946 |
| 279 | F | S | A | S | P | I | F | T | D | T | V | V | F | R | V | 1 | 14947 |
| 280 | S | A | S | P | I | F | T | D | T | V | V | F | R | V | A | 1 | 14948 |
| 285 | F | T | D | T | V | V | F | R | V | A | P | W | I | M | T | 1 | 14949 |
| 296 | W | I | M | T | P | S | T | L | P | P | L | E | V | Y | V | 1 | 14950 |
| 308 | V | Y | V | C | R | V | R | N | N | T | C | F | V | D | A | 1 | 14951 |
| 324 | A | E | L | A | R | K | A | G | C | K | L | T | I | C | P | 1 | 14952 |
| 326 | L | A | R | K | A | G | C | K | L | T | I | C | P | Q | A | 1 | 14953 |
| 334 | L | T | I | C | P | Q | A | E | N | R | N | D | R | W | I | 1 | 14954 |
| 337 | C | P | Q | A | E | N | R | N | D | R | W | I | Q | D | E | 1 | 14955 |
| 347 | W | I | Q | D | E | M | E | L | G | Y | V | Q | A | P | H | 1 | 14956 |
| 356 | Y | V | Q | A | P | H | K | T | L | P | V | V | F | D | S | 1 | 14957 |
| 357 | V | Q | A | P | H | K | T | L | P | V | V | F | D | S | P | 1 | 14958 |
| 366 | V | V | F | D | S | P | R | N | G | E | L | Q | D | F | P | 1 | 14959 |
| 372 | R | N | G | E | L | Q | D | F | P | Y | K | R | I | L | G | 1 | 14960 |
| 390 | G | Y | V | T | R | E | P | R | D | R | S | V | S | G | L | 1 | 14961 |
| 396 | P | R | D | R | S | V | S | G | L | D | S | F | G | N | L | 1 | 14962 |
| 400 | S | V | S | G | L | D | S | F | G | N | L | E | V | S | P | 1 | 14963 |
| 412 | V | S | P | P | V | V | A | N | G | K | E | Y | P | L | G | 1 | 14964 |
| 450 | L | H | A | Q | K | V | Q | P | P | V | E | L | F | V | D | 1 | 14965 |
| 451 | H | A | Q | K | V | Q | P | P | V | E | L | F | V | D | W | 1 | 14966 |
| 454 | K | V | Q | P | P | V | E | L | F | V | D | W | L | A | V | 1 | 14967 |
| 466 | L | A | V | G | H | V | D | E | F | L | S | F | V | P | A | 1 | 14968 |
| 478 | V | P | A | P | D | G | K | G | F | R | M | L | L | A | S | 1 | 14969 |
| 488 | M | L | L | A | S | P | G | A | C | F | K | L | F | Q | E | 1 | 14970 |
| 489 | L | L | A | S | P | G | A | C | F | K | L | F | Q | E | K | 1 | 14971 |
| 501 | Q | E | K | Q | K | C | G | H | G | R | A | L | L | F | Q | 1 | 14972 |
| 503 | K | Q | K | C | G | H | G | R | A | L | L | F | Q | G | V | 1 | 14973 |
| 508 | H | G | R | A | L | L | F | Q | G | V | V | D | D | E | Q | 1 | 14974 |
| 543 | F | V | Q | S | C | I | D | W | N | R | E | V | L | K | R | 1 | 14975 |
| 546 | S | C | I | D | W | N | R | E | V | L | K | R | E | L | G | 1 | 14976 |
| 557 | R | E | L | G | L | A | E | C | D | I | I | D | I | P | Q | 1 | 14977 |
| 562 | A | E | C | D | I | I | D | I | P | Q | L | F | K | T | E | 1 | 14978 |
| 578 | K | K | A | T | A | F | F | P | D | L | V | N | M | L | V | 1 | 14979 |
| 579 | K | A | T | A | F | F | P | D | L | V | N | M | L | V | L | 1 | 14980 |
| 597 | L | G | I | P | K | P | F | G | P | I | I | N | G | C | C | 1 | 14981 |
| 599 | I | P | K | P | F | G | P | I | I | N | Q | C | C | L | L | 1 | 14982 |
| 606 | I | I | N | G | C | C | L | E | E | K | V | R | S | L | L | 1 | 14983 |
| 609 | G | C | C | L | E | E | K | V | R | S | L | L | E | P | 1 | 14984 |
| 616 | K | V | R | S | L | L | E | P | L | G | L | H | C | T | F | 1 | 14985 |
| 626 | L | H | C | T | F | I | D | D | F | T | P | Y | H | M | L | 1 | 14986 |
| 639 | M | L | H | G | E | V | H | C | G | T | N | V | C | R | K | 1 | 14987 |
| 640 | L | H | G | E | V | H | C | G | T | N | V | C | R | K | P | 1 | 14988 |
| 648 | T | N | V | C | R | K | P | F | S | F | K | W | W | N | M | 1 | 14989 |

184P1E2 v.2: HLA Peptide Scoring Results DRB1 1101 15-mers SYFPEITHI

| 4 | V | A | P | W | I | M | T | P | S | T | L | A | P | L | E | 17 | 14990 |
|---|---|---|---|---|---|---|---|---|---|---|---|---|---|---|---|---|---|
| 15 | A | P | L | E | V | Y | V | C | R | V | R | N | N | T | C | 16 | 14991 |
| 11 | P | S | T | L | A | P | L | E | V | Y | V | C | R | V | R | 13 | 14992 |
| 1 | V | F | R | V | A | P | W | I | M | T | P | S | T | L | A | 12 | 14993 |
| 5 | A | P | W | I | M | T | P | S | T | L | A | P | L | E | V | 12 | 14994 |
| 14 | L | A | P | L | E | V | Y | V | C | R | V | R | N | N | T | 11 | 14995 |
| 6 | P | W | I | M | T | P | S | T | L | A | P | L | E | V | Y | 8 | 14996 |
| 13 | T | L | A | P | L | E | V | Y | V | C | R | V | R | N | N | 8 | 14997 |
| 2 | F | R | V | A | P | W | I | M | T | P | S | T | L | A | P | 6 | 14998 |
| 3 | R | V | A | P | W | I | M | T | P | S | T | L | A | P | L | 6 | 14999 |
| 8 | I | M | T | P | S | T | L | A | P | L | E | V | Y | V | C | 6 | 15000 |
| 9 | M | T | P | S | T | L | A | P | L | E | V | Y | V | C | R | 3 | 15001 |
| 12 | S | T | L | A | P | L | E | V | Y | V | C | R | V | R | N | 2 | 15002 |
| 7 | W | I | M | T | P | S | T | L | A | P | L | E | V | Y | V | 1 | 15003 |

184P1E2 v.3: HLA Peptide Scoring Results DRB1 1101 15-mers SYFPEITHI

| 9 | F | L | S | F | V | P | V | P | D | G | K | G | F | R | M | 23 | 15004 |
|---|---|---|---|---|---|---|---|---|---|---|---|---|---|---|---|---|---|
| 7 | D | E | F | L | S | F | V | P | V | P | D | G | K | G | F | 18 | 15005 |
| 3 | V | G | H | V | D | E | F | L | S | F | V | P | V | P | D | 13 | 15006 |
| 6 | V | D | E | F | L | S | F | V | P | V | P | D | G | K | G | 12 | 15007 |
| 14 | P | V | P | D | G | K | G | F | R | M | L | L | A | S | P | 9 | 15008 |
| 5 | H | V | D | E | F | L | S | F | V | P | V | P | D | G | K | 8 | 15009 |
| 11 | S | F | V | P | V | P | D | G | K | G | F | R | M | L | L | 8 | 15010 |
| 12 | F | V | P | V | P | D | G | K | G | F | R | M | L | L | A | 8 | 15011 |
| 10 | L | S | F | V | P | V | P | D | G | K | G | F | R | M | L | 7 | 15012 |
| 15 | V | P | D | G | K | G | F | R | M | L | L | A | S | P | G | 7 | 15013 |
| 4 | G | H | V | D | E | F | L | S | F | V | P | V | P | D | G | 6 | 15014 |
| 8 | E | F | L | S | F | V | P | V | P | D | G | K | G | F | R | 4 | 15015 |

TABLE LI-continued

| Pos | 1 | 2 | 3 | 4 | 5 | 6 | 7 | 8 | 9 | 0 | 1 | 2 | 3 | 4 | 5 | score | SEQ. ID NO. |
|---|---|---|---|---|---|---|---|---|---|---|---|---|---|---|---|---|---|
| 1 | L | A | V | G | H | V | D | E | F | L | S | F | V | P | V | 1 | 15016 |
| 13 | V | P | V | P | D | G | K | G | F | R | M | L | L | A | S | 1 | 15017 |

TABLE LII

Search Peptides

184P1E2 v.1: For all 184P1E2 v.1 - nonamers, decamers and 15-mers

```
  1  MSLQRIVRVS  LEHPTSAVCV  AGVETLVDIY  GSVPEGTEMF  EVYGTPGVDI  YISPNMERGR
 61  ERADTRRWRF  DATLEIIVVM  NSPSNDLNDS  HVQISYHSSH  EPLPLAYAVL  YLTCVDISLD
121  CDLNCEGRQD  RNFVDKRQWV  WGPSGYGGIL  LVNCDRDDPS  CDVQDNCDQH  VHCLQDLEDM
181  SVMVLRTQGP  AALFDDHKLV  LHTSSYDAKR  AQVFHICGPE  DVCEAYRHVL  GQDKVSYEVP
241  RLHGDEERFF  VEGLSFPDAG  FTGLISFHVT  LLDDSNEDFS  ASPIFTDTVV  FRVAPWIMTP
301  STLPPLEVYV  CRVRNNTCFV  DAVAELARKA  GCKLTICPQA  ENRNDRWIQD  EMELGYVQAP
361  HKTLPVVFDS  PRNGELQDFP  YKRILGPDFG  YVTREPRDRS  VSGLDSFGNL  EVSPPVVANG
421  KEYPLGRILI  GGNLPGSSGR  RVTQVVRDFL  HAQKVQPPVE  LFVDWLAVGH  VDEFLSFVPA
481  PDGKGFRMLL  ASPGACFKLF  QEKQKCGHGR  ALLFQGVVDD  EQVKTISINQ  VLSNKDLINY
541  NKFVQSCIDW  NREVLKRELG  LAECDIIDIP  QLFKTERKKA  TAFFPDLVNM  LVLGKHLGIP
601  KPFGPIINGC  CCLEEKVRSL  LEPLGLHCTF  IDDFTPYHML  HGEVHCGTNV  CRKPFSFKWW
661  NMVP (aa. 1–664)
```

184P1E2 v.2:

184P1E2 v.2 nonamers
WIMTPSTLAPLEVYVCR (aa. 296–312)
184P1E2 v.2 decamers
PWIMTPSTLAPLEVYVCRV (aa. 295–313)
184P1E2 v.2 15-mers
VFRVAPWIMTPSTLAPLEVYVCRVRNNTC (aa. 290–318)

184P1E2 v.3:

184P1E2 v.3 nonamers
DEFLSFVPVPDGKGFRM (aa. 472–488)
184P1E2 v.3 decamers
VDEFLSFVPVPDGKGFRML (aa. 471–489)
184P1E2 v.3 15-mers
LAVGHVDEFLSFVPVPDGKGFRMLLASPG (aa. 466–494)

TABLE LIII

Clustal Alignment of the three 184P1E2 variants Showing SNP Modifications.

```
v.1  MSLQRIVRVSLEHPTSAVCVAGVETLVDIYGSVPEGTEMFEVYGTPGVDIYISPNMERGR
v.2  MSLQRIVRVSLEHPTSAVCVAGVETLVDIYGSVPEGTEMFEVYGTPGVDIYISPNMERGR
v.3  MSLQRIVRVSLEHPTSAVCVAGVETLVDIYGSVPEGTEMFEVYGTPGVDIYISPNMERGR
     ************************************************************ v.1  ERADTRRWRFDATLEIIVVMNSPSNDLNDSHVQISYHSSHEPLPLAYAVLYLTCVDISLD
v.2  ERADTRRWRFDATLEIIVVMNSPSNDLNDSHVQISYHSSHEPLPLAYAVLYLTCVDISLD
v.3  ERADTRRWRFDATLEIIVVMNSPSNDLNDSHVQISYHSSHEPLPLAYAVLYLTCVDISLD
     ************************************************************ v.1  CDLNCEGRQDRNFVDKRQWVWGPSGYGGILLVNCDRDDPSCDVQDNCDQHVHCLQDLEDM
v.2  CDLNCEGRQDRNFVDKRQWVWGPSGYGGILLVNCDRDDPSCDVQDNCDQHVHCLQDLEDM
v.3  CDLNCEGRQDRNFVDKRQWVWGPSGYGGILLVNCDRDDPSCDVQDNCDQHVHCLQDLEDM
     ************************************************************ v.1  SVMVLRTQGPAALFDDHKLVLHTSSYDAKRAQVFHICGPEDVCEAYRHVLGQDKVSYEVP
v.2  SVMVLRTQGPAALFDDHKLVLHTSSYDAKRAQVFHICGPEDVCEAYRHVLGQDKVSYEVP
v.3  SVMVLRTQGPAALFDDHKLVLHTSSYDAKRAQVFHICGPEDVCEAYRHVLGQDKVSYEVP
     ************************************************************ v.1  RLHGDEERFFVEGLSFPDAGFTGLISFHVTLLDDSNEDFSASPIFTDTVVFRVAPWIMTP
v.2  RLHGDEERFFVEGLSFPDAGFTGLISFHVTLLDDSNEDFSASPIFTDTVVFRVAPWIMTP
v.3  RLHGDEERFFVEGLSFPDAGFTGLISFHVTLLDDSNEDFSASPIFTDTVVFRVAPWIMTP
     ************************************************************ v.1  STL PLEVYVCRVRNNTCFVDAVAELARKAGCKLTICPQAENRNDRWIQDEMELGYVQAP
v.2  STL PLEVYVCRVRNNTCFVDAVAELARKAGCKLTICPQAENRNDRWIQDEMELGYVQAP
v.3  STL PLEVYVCRVRNNTCFVDAVAELARKAGCKLTICPQAENRNDRWIQDEMELGYVQAP
     *** ,********************************************************
```

TABLE LIII-continued

Clustal Alignment of the three 184P1E2 variants Showing SNP Modifications.

```
v.1  HKTLPVVFDSPRNGELQDFPYKRILGPDFGYVTREPRDRSVSGLDSFGNLEVSPPVVANG
v.2  HKTLPVVFDSPRNGELQDFPYKRILGPDFGYVTREPRDRSVSGLDSFGNLEVSPPVVANG
v.3  HKTLPVVFDSPRNGELQDFPYKRILGPDFGYVTREPRDRSVSGLDSFGNLEVSPPVVANG
     ************************************************************ v.1  KEYPLGRILIGGNLPGSSGRRVTQVVRDFLHAQKVQPPVELFVDWLAVGHVDEFLSFVP
v.2  KEYPLGRILIGGNLPGSSGRRVTQVVRDFLHAQKVQPPVELFVDWLAVGHVDEFLSFVP
v.3  KEYPLGRILIGGNLPGSSGRRVTQVVRDFLHAQKVQPPVELFVDWLAVGHVDEFLSFVP
     ************************************************************ v.1  PDGKGFRMLLASPGACFKLFQEKQKCGHGRALLFQGVVDDEQVKTISINQVLSNKDLINY
v.2  PDGKGFRMLLASPGACFKLFQEKQKCGHGRALLFQGVVDDEQVKTISINQVLSNKDLINY
v.3  PDGKGFRMLLASPGACFKLFQEKQKCGHGRALLFQGVVDDEQVKTISINQVLSNKDLINY
     ************************************************************ v.1  NKFVQSCIDWNREVLKRELGLAECDIIDIPQLFKTERKKATAFFPDLVNMLVLGKHLGIP
v.2  NKFVQSCIDWNREVLKRELGLAECDIIDIPQLFKTERKKATAFFPDLVNMLVLGKHLGIP
v.3  NKFVQSCIDWNREVLKRELGLAECDIIDIPQLFKTERKKATAFFPDLVNMLVLGKHLGIP
     ************************************************************ v.1  KPFGPIINGCCCLEEKVRSLLEPLGLHCTFIDDFTPYHMLHGEVHCGTNVCRKPFSFKWW
v.2  KPFGPIINGCCCLEEKVRSLLEPLGLHCTFIDDFTPYHMLHGEVHCGTNVCRKPFSFKWW
v.3  KPFGPIINGCCCLEEKVRSLLEPLGLHCTFIDDFTPYHMLHGEVHCGTNVCRKPFSFKWW
     ************************************************************ v.1  NMVP
v.2  NMVP
v.3  NMVP
     ****
```

SEQUENCE LISTING (15017 sequences)

SEQ ID NO: 1 - DNA, 132 bp, Homo Sapiens
gatccacagctccctttttatgggggaggctttaggaagaatctctcctgcctgtcctgcgtggagtggtctggttttagggttgttcctctgcagagaggaagcaattggaccaaagcagaatcatggatc

SEQ ID NO: 2 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 3 - protein, 664 aa, Homo Sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 4 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctggcacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 5 - protein, 664 aa, Homo Sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLAPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 6 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgtccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 7 - protein, 664 aa, Homo Sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPVPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 8 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 9 - protein, 664 aa, Homo Sapiens; identical to SEQ ID NO: 3

SEQ ID NO: 10 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccctaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 11 - protein, 664 aa, Homo Sapiens; identical to SEQ ID NO: 3

SEQ ID NO: 12 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctgtcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 13 - protein, 664 aa, Homo Sapiens; identical to SEQ ID NO: 3

SEQ ID NO: 14 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaatttcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 15 - protein, 664 aa, Homo Sapiens; identical to SEQ ID NO: 3

SEQ ID NO: 16 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaccgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 17 - protein, 664 aa, Homo Sapiens; identical to SEQ ID NO: 3

SEQ ID NO: 18 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggaatgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 19 - protein, 664 aa, Homo Sapiens; identical to SEQ ID NO: 3

SEQ ID NO: 20 - DNA, 3183 bp, Homo Sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctagcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 21 - protein, 664 aa, Homo Sapiens; identical to SEQ ID NO: 3

SEQ ID NO: 22 - DNA, 3183 bp, Homo Sapiens
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctagcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgtccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 23 - protein, 664 aa, Homo Sapiens; identical to SEQ ID NO: 7

SEQ ID NO: 24 - protein, 664 aa, Mus musculus
MSLQRIVRVSLEHPTSAVCVAGVETIVDIYGSVPEGTDMFEVYGTPGVDIYLSPSMERNRERADTRRWCFNKGLEIIVVMNSPSNDLNDSHVQIAYHSSREHLPLAYAVLYLTCVDITLDCDMNCADRQDRSFVDKRQWVWGPDGYGAILLVNCDRDNVDSNAQDNCDQYVRCLQDLEDMSVMVLRTQGPEALFEDHRLILHTSSCDAERARVFHVCGPEDSCEAYKCVLGPDRMSYEVPRLKGYEERFFVEGLSFPDAGFPGLISFHVTLLDDSNEDFSETPIFTDTAVFRVAPWIMTPSTLPPLEVYVCRVRNNTCFVEAVEELARKAGCKLTICPQAENRNDRWIQDEMELGYVQAPHKTLPVVFDSPRNGELQGFPYKRILGLDFGYVTREPKDSSVSGLDSFGNLEVSPPVVANGKEYPLGRILIGGNLPGSRGRRVTQVVRNFLHAQKVQPLVELFVDWLAVGHVDEFLSFVPAPDGKGFRLLLASPGACFRLFQEKQKWGHGRSLLFEGVIGDRRVQTVSINQILNNQSLINFNKFAQSCIDWNREVLKRELGLAEGDIIDIPQLFKTEKRKAVAFFPDLVNMLVLGKHLGIPKPFGPIINGRCCLEEKVRSLLEPLGLHCTFIDDFTPYHMLHGEVHCGTNVRREPFAFKWWHMVP

SEQ ID NO: 25 - protein, 664 aa, Rattus ratticus
MSLQRTVRVSLEHPTSAVCVAGVETIVDIYGSVPEGTDMFEVYGTPGVDIYVSPSMERNRERADTRRWCFNKGLEIIVVMNSPSNDLNDSHVQIAYHSSHEHLPLAYAVLYLTCVDITLDCDMNCADRQDRSFVDKRQWMWGPDGYGAILLVNCDRDEVSSDAQDNCDQCVRCLQDLEDMSVMVLRTQGPESLFDDHRLILHTSSCDAERARVFHVCGPEDSCEAYRCVLGPDRMSYEVPRLKGYEERFYVEGLSFPDAGFPGILSFHITLLDDSNEDYSETPIFTDTVVFRVAPWIMTPSTLPPLEVYVCQVRNNTCFVEAVEELARKAGCKLTICPQAENRNDRWIQDEMELGYTQAPHKTLPVVFDSPRNGELQGFPYKRILGLDFGYVTREPPDSSVSGLDSFGNLEVSPPVVANGKEYPLGRILIGGNLPGSRGRRVTQVVRDFLHAQKVQPLVELFVDWLAVGHVDEFLSFVPAPDGKGFRLLLASPGACFRLFQEKQKWGHGRSLLFEGVIGDRRVQTISINQVLSNQSLINFNKFAQSCIDWNREVLKRELGLGESDIIDIPQLFKSEKRKAVAFFPDLVNMLVLGKHLGIPKPFGPIINGRCCLEEKVRSLLEPLGLHCTFIDDFTPYHMLHGEVHCGTNVRREPFAFKWWHMVP

SEQ ID NO: 26-28 - skipped (3 entries)

SEQ ID NO: 29 - protein, 14 aa, Clostridium tetani
QYIKANSKFIGITE

SEQ ID NO: 30 - protein, 21 aa, Plasmodium falciparum
DIEKKIAKMEKASSVFNVVNS

SEQ ID NO: 31 - protein, 16 aa, Streptococcu Aureus
GAVDSILGGVATYGAA

SEQ ID NO: 32 - protein, 13 aa, Artificial Sequence
  Artificially Synthesized Peptide
  VARIANT 3: Xaa = cyclohexylalanine, phenylalanine, or tyrosine
  VARIANT 1, 13: Xaa = D-alanine or L-alanine
XKXVAAWTLKAAX

SEQ ID NO: 33 - DNA, 14 bp, Artificial Sequence
  Artificially Synthesized Primer
ttttgatcaagctt

SEQ ID NO: 34 - DNA, 42 bp, Artificial Sequence
  Artificially Synthesized Primer
ctaatacgactcactatagggctcgagcggccgcccgggcag

SEQ ID NO: 35 - DNA, 12 bp, Artificial Sequence
  Artificially Synthesized Primer
gatcctgcccgg

SEQ ID NO: 36 - DNA, 40 bp, Artificial Sequence
  Artificially Synthesized Primer
gtaatacgactcactatagggcagcgtggtcgcggccgag

SEQ ID NO: 37 - DNA, 10 bp, Artificial Sequence
  Artificially Synthesized Primer
gatcctcggc

SEQ ID NO: 38 - DNA, 22 bp, Artificial Sequence
  Artificially Synthesized Primer
ctaatacgactcactatagggc

SEQ ID NO: 39 - DNA, 22 bp, Artificial Sequence
  Artificially Synthesized Primer
tcgagcggccgcccgggcagga

SEQ ID NO: 40 - DNA, 20 bp, Artificial Sequence
  Artificially Synthesized Primer
agcgtggtcgcggccgagga

SEQ ID NO: 41 - DNA, 25 bp, Artificial Sequence
  Artificially Synthesized Primer
atatcgccgcgctcgtcgtcgacaa

SEQ ID NO: 42 - DNA, 26 bp, Artificial Sequence
  Artificially Synthesized Primer
agccacacgcagctcattgtagaagg

SEQ ID NO: 43 - DNA, 24 bp, Artificial Sequence
  Artificially Synthesized Primer
agtgacatggaaggagatgagtcc

SEQ ID NO: 44 - DNA, 24 bp, Artificial Sequence
  Artificially Synthesized Primer
atacctccagctatgatgccaaac

SEQ ID NO: 45 - DNA, 24 bp, Artificial Sequence
  Artificially Synthesized Primer
gattacaaggatgacgacgataag

SEQ ID NO: 46 - protein, 9 aa, Homo Sapiens
SHEPLPLAY

SEQ ID NO: 47 - protein, 9 aa, Homo Sapiens
NGELQDFPY

SEQ ID NO: 48 - protein, 9 aa, Homo Sapiens
IIDIPQLFK

SEQ ID NO: 49 - protein, 9 aa, Homo Sapiens
LLEPLGLHC

SEQ ID NO: 50 - protein, 9 aa, Homo Sapiens
GVETLVDIY

SEQ ID NO: 51 - protein, 9 aa, Homo Sapiens
IQDEMELGY

SEQ ID NO: 52 - protein, 9 aa, Homo Sapiens
STLPPLEVY

SEQ ID NO: 53 - protein, 9 aa, Homo Sapiens
GPEDVCEAY

SEQ ID NO: 54 - protein, 9 aa, Homo Sapiens
FTDTVVFRV

SEQ ID NO: 55 - protein, 9 aa, Homo Sapiens
DCDLNCEGR

SEQ ID NO: 56 - protein, 9 aa, Homo Sapiens
LLDDSNEDF

SEQ ID NO: 57 - protein, 9 aa, Homo Sapiens
RADTRRWRF

SEQ ID NO: 58 - protein, 9 aa, Homo Sapiens
LAECDIIDI

SEQ ID NO: 59 - protein, 9 aa, Homo Sapiens
GTEMFEVYG

SEQ ID NO: 60 - protein, 9 aa, Homo Sapiens
ECDIIDIPQ

SEQ ID NO: 61 - protein, 9 aa, Homo Sapiens
RILGPDFGY

SEQ ID NO: 62 - protein, 9 aa, Homo Sapiens
GPDFGYVTR

SEQ ID NO: 63 - protein, 9 aa, Homo Sapiens
LASPGACFK

SEQ ID NO: 64 - protein, 9 aa, Homo Sapiens
TLEIIVVMN

SEQ ID NO: 65 - protein, 9 aa, Homo Sapiens
NLEVSPPVV

SEQ ID NO: 66 - protein, 9 aa, Homo Sapiens
DLEDMSVMV

SEQ ID NO: 67 - protein, 9 aa, Homo Sapiens
YGTPGVDIY

SEQ ID NO: 68 - protein, 9 aa, Homo Sapiens
KTLPVVFDS

SEQ ID NO: 69 - protein, 9 aa, Homo Sapiens
VVDDEQVKT

SEQ ID NO: 70 - protein, 9 aa, Homo Sapiens
KVQPPVELF

SEQ ID NO: 71 - protein, 9 aa, Homo Sapiens
LVNMLVLGK

SEQ ID NO: 72 - protein, 9 aa, Homo Sapiens
FVDWLAVGH

SEQ ID NO: 73 - protein, 9 aa, Homo Sapiens
TICPQAENR

SEQ ID NO: 74 - protein, 9 aa, Homo Sapiens
VRDFLHAQK

SEQ ID NO: 75 - protein, 9 aa, Homo Sapiens
FIDDFTPYH

SEQ ID NO: 76 - protein, 9 aa, Homo Sapiens
VLGQDKVSY

SEQ ID NO: 77 - protein, 9 aa, Homo Sapiens
NKDLINYNK

SEQ ID NO: 78 - protein, 9 aa, Homo Sapiens
CLEEKVRSL

SEQ ID NO: 79 - protein, 9 aa, Homo Sapiens
VCEAYRHVL

SEQ ID NO: 80 - protein, 9 aa, Homo Sapiens
EMELGYVQA

SEQ ID NO: 81 - protein, 9 aa, Homo Sapiens
QAENRNDRW

SEQ ID NO: 82 - protein, 9 aa, Homo Sapiens
VAELARKAG

SEQ ID NO: 83 - protein, 9 aa, Homo Sapiens
SLEHPTSAV

SEQ ID NO: 84 - protein, 9 aa, Homo Sapiens
NCEGRQDRN

SEQ ID NO: 85 - protein, 9 aa, Homo Sapiens
HGDEERFFV

SEQ ID NO: 86 - protein, 9 aa, Homo Sapiens
APDGKGFRM

SEQ ID NO: 87 - protein, 9 aa, Homo Sapiens
FPDLVNMLV

SEQ ID NO: 88 - protein, 9 aa, Homo Sapiens
KLVLHTSSY

SEQ ID NO: 89 - protein, 9 aa, Homo Sapiens
FVDAVAELA

SEQ ID NO: 90 - protein, 9 aa, Homo Sapiens
HVDEFLSFV

SEQ ID NO: 91 - protein, 9 aa, Homo Sapiens
RTQGPAALF

SEQ ID NO: 92 - protein, 9 aa, Homo Sapiens
GVDIYISPN

SEQ ID NO: 93 - protein, 9 aa, Homo Sapiens
CIDWNREVL

SEQ ID NO: 94 - protein, 9 aa, Homo Sapiens
NCDQHVHCL

SEQ ID NO: 95 - protein, 9 aa, Homo Sapiens
HTSSYDAKR

SEQ ID NO: 96 - protein, 9 aa, Homo Sapiens
KTERKKATA

SEQ ID NO: 97 - protein, 9 aa, Homo Sapiens
TREPRDRSV

SEQ ID NO: 98 - protein, 9 aa, Homo Sapiens
FVEGLSFPD

SEQ ID NO: 99 - protein, 9 aa, Homo Sapiens
DAVAELARK

SEQ ID NO: 100 - protein, 9 aa, Homo Sapiens
LSNKDLINY

SEQ ID NO: 101 - protein, 9 aa, Homo Sapiens
LQDLEDMSV

SEQ ID NO: 102 - protein, 9 aa, Homo Sapiens
VSPPVVANG

SEQ ID NO: 103 - protein, 9 aa, Homo Sapiens
RQDRNFVDK

SEQ ID NO: 104 - protein, 9 aa, Homo Sapiens
GNLPGSSGR

SEQ ID NO: 105 - protein, 9 aa, Homo Sapiens
GTNVCRKPF

SEQ ID NO: 106 - protein, 9 aa, Homo Sapiens
LPLAYAVLY

SEQ ID NO: 107 - protein, 9 aa, Homo Sapiens
RDDPSCDVQ

SEQ ID NO: 108 - protein, 9 aa, Homo Sapiens
VPAPDGKGF

SEQ ID NO: 109 - protein, 9 aa, Homo Sapiens
HGEVHCGTN

SEQ ID NO: 110 - protein, 9 aa, Homo Sapiens
SYEVPRLHG

SEQ ID NO: 111 - protein, 9 aa, Homo Sapiens
GLSFPDAGF

SEQ ID NO: 112 - protein, 9 aa, Homo Sapiens
TLPPLEVYV

SEQ ID NO: 113 - protein, 9 aa, Homo Sapiens
HCGTNVCRK

SEQ ID NO: 114 - protein, 9 aa, Homo Sapiens
EVSPPVVAN

SEQ ID NO: 115 - protein, 9 aa, Homo Sapiens
SINQVLSNK

SEQ ID NO: 116 - protein, 9 aa, Homo Sapiens
GVVDDEQVK

SEQ ID NO: 117 - protein, 9 aa, Homo Sapiens
LLASPGACF

SEQ ID NO: 118 - protein, 9 aa, Homo Sapiens
ELQDFPYKR

SEQ ID NO: 119 - protein, 9 aa, Homo Sapiens
RSVSGLDSF

SEQ ID NO: 120 - protein, 9 aa, Homo Sapiens
LSFPDAGFT

SEQ ID NO: 121 - protein, 9 aa, Homo Sapiens
ISPNMERGR

SEQ ID NO: 122 - protein, 9 aa, Homo Sapiens
GSVPEGTEM

SEQ ID NO: 123 - protein, 9 aa, Homo Sapiens
FTGLISFHV

SEQ ID NO: 124 - protein, 9 aa, Homo Sapiens
CGHGRALLF

SEQ ID NO: 125 - protein, 9 aa, Homo Sapiens
FTPYHMLHG

SEQ ID NO: 126 - protein, 9 aa, Homo Sapiens
AGFTGLISF

SEQ ID NO: 127 - protein, 9 aa, Homo Sapiens
EGTEMFEVY

SEQ ID NO: 128 - protein, 9 aa, Homo Sapiens
GTPGVDIYI

SEQ ID NO: 129 - protein, 9 aa, Homo Sapiens
NDSHVQISY

SEQ ID NO: 130 - protein, 9 aa, Homo Sapiens
FPDAGFTGL

SEQ ID NO: 131 - protein, 9 aa, Homo Sapiens
LEDMSVMVL

SEQ ID NO: 132 - protein, 9 aa, Homo Sapiens
SNDLNDSHV

SEQ ID NO: 133 - protein, 9 aa, Homo Sapiens
LFDDHKLVL

SEQ ID NO: 134 - protein, 9 aa, Homo Sapiens
LNDSHVQIS

SEQ ID NO: 135 - protein, 9 aa, Homo Sapiens
VPEGTEMFE

SEQ ID NO: 136 - protein, 9 aa, Homo Sapiens
NLPGSSGRR

SEQ ID NO: 137 - protein, 9 aa, Homo Sapiens
CCCLEEKVR

SEQ ID NO: 138 - protein, 9 aa, Homo Sapiens
YISPNMERG

SEQ ID NO: 139 - protein, 9 aa, Homo Sapiens
LGYVQAPHK

SEQ ID NO: 140 - protein, 9 aa, Homo Sapiens
LAVGHVDEF

SEQ ID NO: 141 - protein, 9 aa, Homo Sapiens
RLHGDEERF

SEQ ID NO: 142 - protein, 9 aa, Homo Sapiens
SVPEGTEMF

SEQ ID NO: 143 - protein, 9 aa, Homo Sapiens
ILGPDFGYV

SEQ ID NO: 144 - protein, 9 aa, Homo Sapiens
DIIDIPQLF

SEQ ID NO: 145 - protein, 9 aa, Homo Sapiens
NCDRDDPSC

SEQ ID NO: 146 - protein, 9 aa, Homo Sapiens
STLAPLEVY

SEQ ID NO: 147 - protein, 9 aa, Homo Sapiens
TLAPLEVYV

SEQ ID NO: 148 - protein, 9 aa, Homo Sapiens
APLEVYVCR

SEQ ID NO: 149 - protein, 9 aa, Homo Sapiens
MTPSTLAPL

SEQ ID NO: 150 - protein, 9 aa, Homo Sapiens
IMTPSTLAP

SEQ ID NO: 151 - protein, 9 aa, Homo Sapiens
LAPLEVYVC

SEQ ID NO: 152 - protein, 9 aa, Homo Sapiens
WIMTPSTLA

SEQ ID NO: 153 - protein, 9 aa, Homo Sapiens
PSTLAPLEV

SEQ ID NO: 154 - protein, 9 aa, Homo Sapiens
TPSTLAPLE

SEQ ID NO: 155 - protein, 9 aa, Homo Sapiens
VPDGKGFRM

SEQ ID NO: 156 - protein, 9 aa, Homo Sapiens
VPVPDGKGF

SEQ ID NO: 157 - protein, 9 aa, Homo Sapiens
SFVPVPDGK

SEQ ID NO: 158 - protein, 9 aa, Homo Sapiens
LSFVPVPDG

SEQ ID NO: 159 - protein, 9 aa, Homo Sapiens
PVPDGKGFR

SEQ ID NO: 160 - protein, 9 aa, Homo Sapiens
FVPVPDGKG

SEQ ID NO: 161 - protein, 9 aa, Homo Sapiens
FLSFVPVPD

SEQ ID NO: 162 - protein, 9 aa, Homo Sapiens
DEFLSFVPV

SEQ ID NO: 163 - protein, 9 aa, Homo Sapiens
EFLSFVPVP

SEQ ID NO: 164 - protein, 10 aa, Homo Sapiens
LNDSHVQISY

SEQ ID NO: 165 - protein, 10 aa, Homo Sapiens
FVDAVAELAR

SEQ ID NO: 166 - protein, 10 aa, Homo Sapiens
CIDWNREVLK

SEQ ID NO: 167 - protein, 10 aa, Homo Sapiens
NGELQDFPYK

SEQ ID NO: 168 - protein, 10 aa, Homo Sapiens
NCEGRQDRNF

SEQ ID NO: 169 - protein, 10 aa, Homo Sapiens
LLEPLGLHCT

SEQ ID NO: 170 - protein, 10 aa, Homo Sapiens
GPEDVCEAYR

SEQ ID NO: 171 - protein, 10 aa, Homo Sapiens
GVETLVDIYG

SEQ ID NO: 172 - protein, 10 aa, Homo Sapiens
GTEMFEVYGT

SEQ ID NO: 173 - protein, 10 aa, Homo Sapiens
TLEIIVVMNS

SEQ ID NO: 174 - protein, 10 aa, Homo Sapiens
DLEDMSVMVL

SEQ ID NO: 175 - protein, 10 aa, Homo Sapiens
SSHEPLPLAY

SEQ ID NO: 176 - protein, 10 aa, Homo Sapiens
VSPPVVANGK

SEQ ID NO: 177 - protein, 10 aa, Homo Sapiens
GLDSFGNLEV

SEQ ID NO: 178 - protein, 10 aa, Homo Sapiens
WIQDEMELGY

SEQ ID NO: 179 - protein, 10 aa, Homo Sapiens
IIDIPQLFKT

SEQ ID NO: 180 - protein, 10 aa, Homo Sapiens
VLSNKDLINY

SEQ ID NO: 181 - protein, 10 aa, Homo Sapiens
KTERKKATAF

SEQ ID NO: 182 - protein, 10 aa, Homo Sapiens
SLEHPTSAVC

SEQ ID NO: 183 - protein, 10 aa, Homo Sapiens
NLEVSPPVVA

SEQ ID NO: 184 - protein, 10 aa, Homo Sapiens
FVEGLSFPDA

SEQ ID NO: 185 - protein, 10 aa, Homo Sapiens
VCEAYRHVLG

SEQ ID NO: 186 - protein, 10 aa, Homo Sapiens
VAELARKAGC

SEQ ID NO: 187 - protein, 10 aa, Homo Sapiens
GSVPEGTEMF

SEQ ID NO: 188 - protein, 10 aa, Homo Sapiens
CTFIDDFTPY

SEQ ID NO: 189 - protein, 10 aa, Homo Sapiens
FTDTVVFRVA

SEQ ID NO: 190 - protein, 10 aa, Homo Sapiens
VPEGTEMFEV

SEQ ID NO: 191 - protein, 10 aa, Homo Sapiens
GVDIYISPNM

SEQ ID NO: 192 - protein, 10 aa, Homo Sapiens
HVLGQDKVSY

SEQ ID NO: 193 - protein, 10 aa, Homo Sapiens
DIIDIPQLFK

SEQ ID NO: 194 - protein, 10 aa, Homo Sapiens
FIDDFTPYHM

SEQ ID NO: 195 - protein, 10 aa, Homo Sapiens
DLVNMLVLGK

SEQ ID NO: 196 - protein, 10 aa, Homo Sapiens
YISPNMERGR

SEQ ID NO: 197 - protein, 10 aa, Homo Sapiens
ECDIIDIPQL

SEQ ID NO: 198 - protein, 10 aa, Homo Sapiens
QAENRNDRWI

SEQ ID NO: 199 - protein, 10 aa, Homo Sapiens
PLEVYVCRVR

SEQ ID NO: 200 - protein, 10 aa, Homo Sapiens
SHEPLPLAYA

SEQ ID NO: 201 - protein, 10 aa, Homo Sapiens
CLEEKVRSLL

SEQ ID NO: 202 - protein, 10 aa, Homo Sapiens
LSFPDAGFTG

SEQ ID NO: 203 - protein, 10 aa, Homo Sapiens
FPDLVNMLVL

SEQ ID NO: 204 - protein, 10 aa, Homo Sapiens
RNGELQDFPY

SEQ ID NO: 205 - protein, 10 aa, Homo Sapiens
LASPGACFKL

SEQ ID NO: 206 - protein, 10 aa, Homo Sapiens
KVQPPVELFV

SEQ ID NO: 207 - protein, 10 aa, Homo Sapiens
KCGHGRALLF

SEQ ID NO: 208 - protein, 10 aa, Homo Sapiens
NEDFSASPIF

SEQ ID NO: 209 - protein, 10 aa, Homo Sapiens
NCDQHVHCLQ

SEQ ID NO: 210 - protein, 10 aa, Homo Sapiens
DCDLNCEGRQ

SEQ ID NO: 211 - protein, 10 aa, Homo Sapiens
FVDWLAVGHV

SEQ ID NO: 212 - protein, 10 aa, Homo Sapiens
VVDDEQVKTI

SEQ ID NO: 213 - protein, 10 aa, Homo Sapiens
SLDCDLNCEG

SEQ ID NO: 214 - protein, 10 aa, Homo Sapiens
CVDISLDCDL

SEQ ID NO: 215 - protein, 10 aa, Homo Sapiens
SCDVQDNCDQ

SEQ ID NO: 216 - protein, 10 aa, Homo Sapiens
DIYISPNMER

SEQ ID NO: 217 - protein, 10 aa, Homo Sapiens
DAGFTGLISF

SEQ ID NO: 218 - protein, 10 aa, Homo Sapiens
LLDDSNEDFS

SEQ ID NO: 219 - protein, 10 aa, Homo Sapiens
STLPPLEVYV

SEQ ID NO: 220 - protein, 10 aa, Homo Sapiens
LEDMSVMVLR

SEQ ID NO: 221 - protein, 10 aa, Homo Sapiens
TREPRDRSVS

SEQ ID NO: 222 - protein, 10 aa, Homo Sapiens
ELGYVQAPHK

SEQ ID NO: 223 - protein, 10 aa, Homo Sapiens
ISINQVLSNK

SEQ ID NO: 224 - protein, 10 aa, Homo Sapiens
LSFVPAPDGK

SEQ ID NO: 225 - protein, 10 aa, Homo Sapiens
HVDEFLSFVP

SEQ ID NO: 226 - protein, 10 aa, Homo Sapiens
NKDLINYNKF

SEQ ID NO: 227 - protein, 10 aa, Homo Sapiens
LTICPQAENR

SEQ ID NO: 228 - protein, 10 aa, Homo Sapiens
SYDAKRAQVF

SEQ ID NO: 229 - protein, 10 aa, Homo Sapiens
VPAPDGKGFR

SEQ ID NO: 230 - protein, 10 aa, Homo Sapiens
GNLPGSSGRR

SEQ ID NO: 231 - protein, 10 aa, Homo Sapiens
HGEVHCGTNV

SEQ ID NO: 232 - protein, 10 aa, Homo Sapiens
DDEQVKTISI

SEQ ID NO: 233 - protein, 10 aa, Homo Sapiens
SNEDFSASPI

SEQ ID NO: 234 - protein, 10 aa, Homo Sapiens
LLASPGACFK

SEQ ID NO: 235 - protein, 10 aa, Homo Sapiens
MLLASPGACF

SEQ ID NO: 236 - protein, 10 aa, Homo Sapiens
GACFKLFQEK

SEQ ID NO: 237 - protein, 10 aa, Homo Sapiens
EVHCGTNVCR

SEQ ID NO: 238 - protein, 10 aa, Homo Sapiens
TLPPLEVYVC

SEQ ID NO: 239 - protein, 10 aa, Homo Sapiens
ILGPDFGYVT

SEQ ID NO: 240 - protein, 10 aa, Homo Sapiens
EVSPPVVANG

SEQ ID NO: 241 - protein, 10 aa, Homo Sapiens
VLHTSSYDAK

SEQ ID NO: 242 - protein, 10 aa, Homo Sapiens
ASPGACFKLF

SEQ ID NO: 243 - protein, 10 aa, Homo Sapiens
LTCVDISLDC

SEQ ID NO: 244 - protein, 10 aa, Homo Sapiens
AGVETLVDIY

SEQ ID NO: 245 - protein, 10 aa, Homo Sapiens
ATAFFPDLVN

SEQ ID NO: 246 - protein, 10 aa, Homo Sapiens
LDDSNEDFSA

SEQ ID NO: 247 - protein, 10 aa, Homo Sapiens
FPDAGFTGLI

SEQ ID NO: 248 - protein, 10 aa, Homo Sapiens
VGHVDEFLSF

SEQ ID NO: 249 - protein, 10 aa, Homo Sapiens
FDDHKLVLHT

SEQ ID NO: 250 - protein, 10 aa, Homo Sapiens
RFDATLEIIV

SEQ ID NO: 251 - protein, 10 aa, Homo Sapiens
YGTPGVDIYI

SEQ ID NO: 252 - protein, 10 aa, Homo Sapiens
VTQVVRDFLH

SEQ ID NO: 253 - protein, 10 aa, Homo Sapiens
SNDLNDSHVQ

SEQ ID NO: 254 - protein, 10 aa, Homo Sapiens
KRILGPDFGY

SEQ ID NO: 255 - protein, 10 aa, Homo Sapiens
APDGKGFRML

SEQ ID NO: 256 - protein, 10 aa, Homo Sapiens
CGPEDVCEAY

SEQ ID NO: 257 - protein, 10 aa, Homo Sapiens
TNVCRKPFSF

SEQ ID NO: 258 - protein, 10 aa, Homo Sapiens
GCCCLEEKVR

SEQ ID NO: 259 - protein, 10 aa, Homo Sapiens
GLHCTFIDDF

SEQ ID NO: 260 - protein, 10 aa, Homo Sapiens
TICPQAENRN

SEQ ID NO: 261 - protein, 10 aa, Homo Sapiens
SASPIFTDTV

SEQ ID NO: 262 - protein, 10 aa, Homo Sapiens
RLHGDEERFF

SEQ ID NO: 263 - protein, 10 aa, Homo Sapiens
DLNCEGRQDR

SEQ ID NO: 264 - protein, 10 aa, Homo Sapiens
LAPLEVYVCR

SEQ ID NO: 265 - protein, 10 aa, Homo Sapiens
TLAPLEVYVC

SEQ ID NO: 266 - protein, 10 aa, Homo Sapiens
IMTPSTLAPL

SEQ ID NO: 267 - protein, 10 aa, Homo Sapiens
PSTLAPLEVY

SEQ ID NO: 268 - protein, 10 aa, Homo Sapiens
STLAPLEVYV

SEQ ID NO: 269 - protein, 10 aa, Homo Sapiens
TPSTLAPLEV

SEQ ID NO: 270 - protein, 10 aa, Homo Sapiens
MTPSTLAPLE

SEQ ID NO: 271 - protein, 10 aa, Homo Sapiens
WIMTPSTLAP

SEQ ID NO: 272 - protein, 10 aa, Homo Sapiens
APLEVYVCRV

SEQ ID NO: 273 - protein, 10 aa, Homo Sapiens
PWIMTPSTLA

SEQ ID NO: 274 - protein, 10 aa, Homo Sapiens
LSFVPVPDGK

SEQ ID NO: 275 - protein, 10 aa, Homo Sapiens
VPVPDGKGFR

SEQ ID NO: 276 - protein, 10 aa, Homo Sapiens
VPDGKGFRML

SEQ ID NO: 277 - protein, 10 aa, Homo Sapiens
FVPVPDGKGF

SEQ ID NO: 278 - protein, 10 aa, Homo Sapiens
VDEFLSFVPV

SEQ ID NO: 279 - protein, 10 aa, Homo Sapiens
FLSFVPVPDG

SEQ ID NO: 280 - protein, 10 aa, Homo Sapiens
SFVPVPDGKG

SEQ ID NO: 281 - protein, 10 aa, Homo Sapiens
PVPDGKGFRM

SEQ ID NO: 282 - protein, 10 aa, Homo Sapiens
DEFLSFVPVP

SEQ ID NO: 283 - protein, 10 aa, Homo Sapiens
EFLSFVPVPD

SEQ ID NO: 284 - protein, 9 aa, Homo Sapiens
ALFDDHKLV

SEQ ID NO: 285 - protein, 9 aa, Homo Sapiens
TLPPLEVYV

SEQ ID NO: 286 - protein, 9 aa, Homo Sapiens
ILGPDFGYV

SEQ ID NO: 287 - protein, 9 aa, Homo Sapiens
YLTCVDISL

SEQ ID NO: 288 - protein, 9 aa, Homo Sapiens
GLISFHVTL

SEQ ID NO: 289 - protein, 9 aa, Homo Sapiens
VQPPVELFV

SEQ ID NO: 290 - protein, 9 aa, Homo Sapiens
KLFQEKQKC

SEQ ID NO: 291 - protein, 9 aa, Homo Sapiens
NMLVLGKHL

SEQ ID NO: 292 - protein, 9 aa, Homo Sapiens
VLYLTCVDI

SEQ ID NO: 293 - protein, 9 aa, Homo Sapiens
TLVDIYGSV

SEQ ID NO: 294 - protein, 9 aa, Homo Sapiens
ELFVDWLAV

SEQ ID NO: 295 - protein, 9 aa, Homo Sapiens
VVFRVAPWI

SEQ ID NO: 296 - protein, 9 aa, Homo Sapiens
DLINYNKFV

SEQ ID NO: 297 - protein, 9 aa, Homo Sapiens
VMNSPSNDL

SEQ ID NO: 298 - protein, 9 aa, Homo Sapiens
FTGLISFHV

SEQ ID NO: 299 - protein, 9 aa, Homo Sapiens
FTDTVVFRV

SEQ ID NO: 300 - protein, 9 aa, Homo Sapiens
HVDEFLSFV

SEQ ID NO: 301 - protein, 9 aa, Homo Sapiens
KVSYEVPRL

SEQ ID NO: 302 - protein, 9 aa, Homo Sapiens
RMLLASPGA

SEQ ID NO: 303 - protein, 9 aa, Homo Sapiens
FSFKWWNMV

SEQ ID NO: 304 - protein, 9 aa, Homo Sapiens
LISFHVTLL

SEQ ID NO: 305 - protein, 9 aa, Homo Sapiens
YAVLYLTCV

SEQ ID NO: 306 - protein, 9 aa, Homo Sapiens
YVQAPHKTL

SEQ ID NO: 307 - protein, 9 aa, Homo Sapiens
VLHTSSYDA

SEQ ID NO: 308 - protein, 9 aa, Homo Sapiens
KATAFFPDL

SEQ ID NO: 309 - protein, 9 aa, Homo Sapiens
GNLEVSPPV

SEQ ID NO: 310 - protein, 9 aa, Homo Sapiens
MSLQRIVRV

SEQ ID NO: 311 - protein, 9 aa, Homo Sapiens
FEVYGTPGV

SEQ ID NO: 312 - protein, 9 aa, Homo Sapiens
CVAGVETLV

SEQ ID NO: 313 - protein, 9 aa, Homo Sapiens
PLAYAVLYL

SEQ ID NO: 314 - protein, 9 aa, Homo Sapiens
LVLGKHLGI

SEQ ID NO: 315 - protein, 9 aa, Homo Sapiens
AVGHVDEFL

SEQ ID NO: 316 - protein, 9 aa, Homo Sapiens
VQDNCDQHV

SEQ ID NO: 317 - protein, 9 aa, Homo Sapiens
LQDLEDMSV

SEQ ID NO: 318 - protein, 9 aa, Homo Sapiens
VELFVDWLA

SEQ ID NO: 319 - protein, 9 aa, Homo Sapiens
SLEHPTSAV

SEQ ID NO: 320 - protein, 9 aa, Homo Sapiens
MLLASPGAC

SEQ ID NO: 321 - protein, 9 aa, Homo Sapiens
SGYGGILLV

SEQ ID NO: 322 - protein, 9 aa, Homo Sapiens
DLNDSHVQI

SEQ ID NO: 323 - protein, 9 aa, Homo Sapiens
YVCRVRNNT

SEQ ID NO: 324 - protein, 9 aa, Homo Sapiens
GQDKVSYEV

SEQ ID NO: 325 - protein, 9 aa, Homo Sapiens
CLEEKVRSL

SEQ ID NO: 326 - protein, 9 aa, Homo Sapiens
RVRNNTCFV

SEQ ID NO: 327 - protein, 9 aa, Homo Sapiens
NQVLSNKDL

SEQ ID NO: 328 - protein, 9 aa, Homo Sapiens
NNTCFVDAV

SEQ ID NO: 329 - protein, 9 aa, Homo Sapiens
NLEVSPPVV

SEQ ID NO: 330 - protein, 9 aa, Homo Sapiens
VVDDEQVKT

SEQ ID NO: 331 - protein, 9 aa, Homo Sapiens
ATAFFPDLV

SEQ ID NO: 332 - protein, 9 aa, Homo Sapiens
QVLSNKDLI

SEQ ID NO: 333 - protein, 9 aa, Homo Sapiens
FIDDFTPYH

SEQ ID NO: 334 - protein, 9 aa, Homo Sapiens
DLEDMSVMV

SEQ ID NO: 335 - protein, 9 aa, Homo Sapiens
VTQVVRDFL

SEQ ID NO: 336 - protein, 9 aa, Homo Sapiens
GEVHCGTNV

SEQ ID NO: 337 - protein, 9 aa, Homo Sapiens
LAYAVLYLT

SEQ ID NO: 338 - protein, 9 aa, Homo Sapiens
PLGLHCTFI

SEQ ID NO: 339 - protein, 9 aa, Homo Sapiens
TEMFEVYGT

SEQ ID NO: 340 - protein, 9 aa, Homo Sapiens
MTPSTLPPL

SEQ ID NO: 341 - protein, 9 aa, Homo Sapiens
AALFDDHKL

SEQ ID NO: 342 - protein, 9 aa, Homo Sapiens
NFVDKRQWV

SEQ ID NO: 343 - protein, 9 aa, Homo Sapiens
LQDFPYKRI

SEQ ID NO: 344 - protein, 9 aa, Homo Sapiens
SSGRRVTQV

SEQ ID NO: 345 - protein, 9 aa, Homo Sapiens
TSAVCVAGV

SEQ ID NO: 346 - protein, 9 aa, Homo Sapiens
KPFSFKWWN

SEQ ID NO: 347 - protein, 9 aa, Homo Sapiens
ATLEIIVVM

SEQ ID NO: 348 - protein, 9 aa, Homo Sapiens
QAPHKTLPV

SEQ ID NO: 349 - protein, 9 aa, Homo Sapiens
DMSVMVLRT

SEQ ID NO: 350 - protein, 9 aa, Homo Sapiens
ASPIFTDTV

SEQ ID NO: 351 - protein, 9 aa, Homo Sapiens
VSLEHPTSA

SEQ ID NO: 352 - protein, 9 aa, Homo Sapiens
ISLDCDLNC

SEQ ID NO: 353 - protein, 9 aa, Homo Sapiens
FPDLVNMLV

SEQ ID NO: 354 - protein, 9 aa, Homo Sapiens
QVVRDFLHA

SEQ ID NO: 355 - protein, 9 aa, Homo Sapiens
ASPGACFKL

SEQ ID NO: 356 - protein, 9 aa, Homo Sapiens
HGDEERFFV

SEQ ID NO: 357 - protein, 9 aa, Homo Sapiens
GTPGVDIYI

SEQ ID NO: 358 - protein, 9 aa, Homo Sapiens
ELGLAECDI

SEQ ID NO: 359 - protein, 9 aa, Homo Sapiens
RALLFQGVV

SEQ ID NO: 360 - protein, 9 aa, Homo Sapiens
AVCVAGVET

SEQ ID NO: 361 - protein, 9 aa, Homo Sapiens
FFPDLVNML

SEQ ID NO: 362 - protein, 9 aa, Homo Sapiens
AGVETLVDI

SEQ ID NO: 363 - protein, 9 aa, Homo Sapiens
VLRTQGPAA

SEQ ID NO: 364 - protein, 9 aa, Homo Sapiens
LEPLGLHCT

SEQ ID NO: 365 - protein, 9 aa, Homo Sapiens
DVCEAYRHV

SEQ ID NO: 366 - protein, 9 aa, Homo Sapiens
KVRSLLEPL

SEQ ID NO: 367 - protein, 9 aa, Homo Sapiens
LLEPLGLHC

SEQ ID NO: 368 - protein, 9 aa, Homo Sapiens
LGPDFGYVT

SEQ ID NO: 369 - protein, 9 aa, Homo Sapiens
SGLDSFGNL

SEQ ID NO: 370 - protein, 9 aa, Homo Sapiens
EVLKRELGL

SEQ ID NO: 371 - protein, 9 aa, Homo Sapiens
RSLLEPLGL

SEQ ID NO: 372 - protein, 9 aa, Homo Sapiens
VANGKEYPL

SEQ ID NO: 373 - protein, 9 aa, Homo Sapiens
KCGHGRALL

SEQ ID NO: 374 - protein, 9 aa, Homo Sapiens
FPDAGFTGL

SEQ ID NO: 375 - protein, 9 aa, Homo Sapiens
HMLHGEVHC

SEQ ID NO: 376 - protein, 9 aa, Homo Sapiens
APHKTLPVV

SEQ ID NO: 377 - protein, 9 aa, Homo Sapiens
KTISINQVL

SEQ ID NO: 378 - protein, 9 aa, Homo Sapiens
VDWLAVGHV

SEQ ID NO: 379 - protein, 9 aa, Homo Sapiens
APWIMTPST

SEQ ID NO: 380 - protein, 9 aa, Homo Sapiens
PEGTEMFEV

SEQ ID NO: 381 - protein, 9 aa, Homo Sapiens
FVDAVAELA

SEQ ID NO: 382 - protein, 9 aa, Homo Sapiens
KEYPLGRIL

SEQ ID NO: 383 - protein, 9 aa, Homo Sapiens
VKTISINQV

SEQ ID NO: 384 - protein, 9 aa, Homo Sapiens
TLAPLEVYV

SEQ ID NO: 385 - protein, 9 aa, Homo Sapiens
WIMTPSTLA

SEQ ID NO: 386 - protein, 9 aa, Homo Sapiens
MTPSTLAPL

SEQ ID NO: 387 - protein, 9 aa, Homo Sapiens
LAPLEVYVC

SEQ ID NO: 388 - protein, 9 aa, Homo Sapiens
IMTPSTLAP

SEQ ID NO: 389 - protein, 9 aa, Homo Sapiens
PSTLAPLEV

SEQ ID NO: 390 - protein, 9 aa, Homo Sapiens
APLEVYVCR

SEQ ID NO: 391 - protein, 9 aa, Homo Sapiens
STLAPLEVY

SEQ ID NO: 392 - protein, 9 aa, Homo Sapiens
TPSTLAPLE

SEQ ID NO: 393 - protein, 9 aa, Homo Sapiens
DEFLSFVPV

SEQ ID NO: 394 - protein, 9 aa, Homo Sapiens
VPDGKGFRM

SEQ ID NO: 395 - protein, 9 aa, Homo Sapiens
FLSFVPVPD

SEQ ID NO: 396 - protein, 9 aa, Homo Sapiens
LSFVPVPDG

SEQ ID NO: 397 - protein, 9 aa, Homo Sapiens
FVPVPDGKG

SEQ ID NO: 398 - protein, 9 aa, Homo Sapiens
VPVPDGKGF

SEQ ID NO: 399 - protein, 9 aa, Homo Sapiens
PVPDGKGFR

SEQ ID NO: 400 - protein, 9 aa, Homo Sapiens
EFLSFVPVP

SEQ ID NO: 401 - protein, 9 aa, Homo Sapiens
SFVPVPDGK

SEQ ID NO: 402 - protein, 10 aa, Homo Sapiens
CLQDLEDMSV

SEQ ID NO: 403 - protein, 10 aa, Homo Sapiens
ALFDDHKLVL

SEQ ID NO: 404 - protein, 10 aa, Homo Sapiens
KVQPPVELFV

SEQ ID NO: 405 - protein, 10 aa, Homo Sapiens
GLAECDIIDI

SEQ ID NO: 406 - protein, 10 aa, Homo Sapiens
SLLEPLGLHC

SEQ ID NO: 407 - protein, 10 aa, Homo Sapiens
IMTPSTLPPL

SEQ ID NO: 408 - protein, 10 aa, Homo Sapiens
GLISFHVTLL

SEQ ID NO: 409 - protein, 10 aa, Homo Sapiens
RILGPDFGYV

SEQ ID NO: 410 - protein, 10 aa, Homo Sapiens
IQDEMELGYV

SEQ ID NO: 411 - protein, 10 aa, Homo Sapiens
GLDSFGNLEV

SEQ ID NO: 412 - protein, 10 aa, Homo Sapiens
SLQRIVRVSL

SEQ ID NO: 413 - protein, 10 aa, Homo Sapiens
ILGPDFGYVT

SEQ ID NO: 414 - protein, 10 aa, Homo Sapiens
STLPPLEVYV

SEQ ID NO: 415 - protein, 10 aa, Homo Sapiens
QLFKTERKKA

SEQ ID NO: 416 - protein, 10 aa, Homo Sapiens
MLVLGKHLGI

SEQ ID NO: 417 - protein, 10 aa, Homo Sapiens
FQGVVDDEQV

SEQ ID NO: 418 - protein, 10 aa, Homo Sapiens
VELFVDWLAV

SEQ ID NO: 419 - protein, 10 aa, Homo Sapiens
NLPGSSGRRV

SEQ ID NO: 420 - protein, 10 aa, Homo Sapiens
MLHGEVHCGT

SEQ ID NO: 421 - protein, 10 aa, Homo Sapiens
VQAPHKTLPV

SEQ ID NO: 422 - protein, 10 aa, Homo Sapiens
VVMNSPSNDL

SEQ ID NO: 423 - protein, 10 aa, Homo Sapiens
VSLEHPTSAV

SEQ ID NO: 424 - protein, 10 aa, Homo Sapiens
LPLAYAVLYL

SEQ ID NO: 425 - protein, 10 aa, Homo Sapiens
LHGDEERFFV

SEQ ID NO: 426 - protein, 10 aa, Homo Sapiens
GHVDEFLSFV

SEQ ID NO: 427 - protein, 10 aa, Homo Sapiens
IIDIPQLFKT

SEQ ID NO: 428 - protein, 10 aa, Homo Sapiens
RNFVDKRQWV

SEQ ID NO: 429 - protein, 10 aa, Homo Sapiens
VVFRVAPWIM

SEQ ID NO: 430 - protein, 10 aa, Homo Sapiens
CEGRQDRNFV

SEQ ID NO: 431 - protein, 10 aa, Homo Sapiens
KDLINYNKFV

SEQ ID NO: 432 - protein, 10 aa, Homo Sapiens
KATAFFPDLV

SEQ ID NO: 433 - protein, 10 aa, Homo Sapiens
SSYDAKRAQV

SEQ ID NO: 434 - protein, 10 aa, Homo Sapiens
VVDDEQVKTI

SEQ ID NO: 435 - protein, 10 aa, Homo Sapiens
CLEEKVRSLL

SEQ ID NO: 436 - protein, 10 aa, Homo Sapiens
KPFSFKWWNM

SEQ ID NO: 437 - protein, 10 aa, Homo Sapiens
GLSFPDAGFT

SEQ ID NO: 438 - protein, 10 aa, Homo Sapiens
FIDDFTPYHM

SEQ ID NO: 439 - protein, 10 aa, Homo Sapiens
RVTQVVRDFL

SEQ ID NO: 440 - protein, 10 aa, Homo Sapiens
TVVFRVAPWI

SEQ ID NO: 441 - protein, 10 aa, Homo Sapiens
ELQDFPYKRI

SEQ ID NO: 442 - protein, 10 aa, Homo Sapiens
TLPPLEVYVC

SEQ ID NO: 443 - protein, 10 aa, Homo Sapiens
IFTDTVVFRV

SEQ ID NO: 444 - protein, 10 aa, Homo Sapiens
AALFDDHKLV

SEQ ID NO: 445 - protein, 10 aa, Homo Sapiens
AVLYLTCVDI

SEQ ID NO: 446 - protein, 10 aa, Homo Sapiens
FVDWLAVGHV

SEQ ID NO: 447 - protein, 10 aa, Homo Sapiens
VVANGKEYPL

SEQ ID NO: 448 - protein, 10 aa, Homo Sapiens
LGQDKVSYEV

SEQ ID NO: 449 - protein, 10 aa, Homo Sapiens
LASPGACFKL

SEQ ID NO: 450 - protein, 10 aa, Homo Sapiens
GNLEVSPPVV

SEQ ID NO: 451 - protein, 10 aa, Homo Sapiens
VLRTQGPAAL

SEQ ID NO: 452 - protein, 10 aa, Homo Sapiens
MVLRTQGPAA

SEQ ID NO: 453 - protein, 10 aa, Homo Sapiens
LVLHTSSYDA

SEQ ID NO: 454 - protein, 10 aa, Homo Sapiens
GVVDDEQVKT

SEQ ID NO: 455 - protein, 10 aa, Homo Sapiens
LEHPTSAVCV

SEQ ID NO: 456 - protein, 10 aa, Homo Sapiens
KEYPLGRILI

SEQ ID NO: 457 - protein, 10 aa, Homo Sapiens
GIPKPFGPII

SEQ ID NO: 458 - protein, 10 aa, Homo Sapiens
AVCVAGVETL

SEQ ID NO: 459 - protein, 10 aa, Homo Sapiens
FGNLEVSPPV

SEQ ID NO: 460 - protein, 10 aa, Homo Sapiens
YVCRVRNNTC

SEQ ID NO: 461 - protein, 10 aa, Homo Sapiens
TGLISFHVTL

SEQ ID NO: 462 - protein, 10 aa, Homo Sapiens
RNNTCFVDAV

SEQ ID NO: 463 - protein, 10 aa, Homo Sapiens
DVQDNCDQHV

SEQ ID NO: 464 - protein, 10 aa, Homo Sapiens
LLEPLGLHCT

SEQ ID NO: 465 - protein, 10 aa, Homo Sapiens
SASPIFTDTV

SEQ ID NO: 466 - protein, 10 aa, Homo Sapiens
RMLLASPGAC

SEQ ID NO: 467 - protein, 10 aa, Homo Sapiens
YGTPGVDIYI

SEQ ID NO: 468 - protein, 10 aa, Homo Sapiens
ELARKAGCKL

SEQ ID NO: 469 - protein, 10 aa, Homo Sapiens
INYNKFVQSC

SEQ ID NO: 470 - protein, 10 aa, Homo Sapiens
QDLEDMSVMV

SEQ ID NO: 471 - protein, 10 aa, Homo Sapiens
LAVGHVDEFL

SEQ ID NO: 472 - protein, 10 aa, Homo Sapiens
TCFVDAVAEL

SEQ ID NO: 473 - protein, 10 aa, Homo Sapiens
APWIMTPSTL

SEQ ID NO: 474 - protein, 10 aa, Homo Sapiens
GSSGRRVTQV

SEQ ID NO: 475 - protein, 10 aa, Homo Sapiens
CCLEEKVRSL

SEQ ID NO: 476 - protein, 10 aa, Homo Sapiens
KPFGPIINGC

SEQ ID NO: 477 - protein, 10 aa, Homo Sapiens
KLFQEKQKCG

SEQ ID NO: 478 - protein, 10 aa, Homo Sapiens
TQVVRDFLHA

SEQ ID NO: 479 - protein, 10 aa, Homo Sapiens
FFPDLVNMLV

SEQ ID NO: 480 - protein, 10 aa, Homo Sapiens
QAPHKTLPVV

SEQ ID NO: 481 - protein, 10 aa, Homo Sapiens
VNMLVLGKHL

SEQ ID NO: 482 - protein, 10 aa, Homo Sapiens
VMVLRTQGPA

SEQ ID NO: 483 - protein, 10 aa, Homo Sapiens
VCVAGVETLV

SEQ ID NO: 484 - protein, 10 aa, Homo Sapiens
RELGLAECDI

SEQ ID NO: 485 - protein, 10 aa, Homo Sapiens
KKATAFFPDL

SEQ ID NO: 486 - protein, 10 aa, Homo Sapiens
CVDISLDCDL

SEQ ID NO: 487 - protein, 10 aa, Homo Sapiens
VPEGTEMFEV

SEQ ID NO: 488 - protein, 10 aa, Homo Sapiens
TAFFPDLVNM

SEQ ID NO: 489 - protein, 10 aa, Homo Sapiens
VAGVETLVDI

SEQ ID NO: 490 - protein, 10 aa, Homo Sapiens
LAYAVLYLTC

SEQ ID NO: 491 - protein, 10 aa, Homo Sapiens
LLDDSNEDFS

SEQ ID NO: 492 - protein, 10 aa, Homo Sapiens
TLLDDSNEDF

SEQ ID NO: 493 - protein, 10 aa, Homo Sapiens
NQVLSNKDLI

SEQ ID NO: 494 - protein, 10 aa, Homo Sapiens
QVKTISINQV

SEQ ID NO: 495 - protein, 10 aa, Homo Sapiens
MLLASPGACF

SEQ ID NO: 496 - protein, 10 aa, Homo Sapiens
TPSTLPPLEV

SEQ ID NO: 497 - protein, 10 aa, Homo Sapiens
RVSLEHPTSA

SEQ ID NO: 498 - protein, 10 aa, Homo Sapiens
FSASPIFTDT

SEQ ID NO: 499 - protein, 10 aa, Homo Sapiens
FDATLEIIVV

SEQ ID NO: 500 - protein, 10 aa, Homo Sapiens
REVLKRELGL

SEQ ID NO: 501 - protein, 10 aa, Homo Sapiens
DLEDMSVMVL

SEQ ID NO: 502 - protein, 10 aa, Homo Sapiens
IMTPSTLAPL

SEQ ID NO: 503 - protein, 10 aa, Homo Sapiens
STLAPLEVYV

SEQ ID NO: 504 - protein, 10 aa, Homo Sapiens
APLEVYVCRV

SEQ ID NO: 505 - protein, 10 aa, Homo Sapiens
TLAPLEVYVC

SEQ ID NO: 506 - protein, 10 aa, Homo Sapiens
TPSTLAPLEV

SEQ ID NO: 507 - protein, 10 aa, Homo Sapiens
WIMTPSTLAP

SEQ ID NO: 508 - protein, 10 aa, Homo Sapiens
LAPLEVYVCR

SEQ ID NO: 509 - protein, 10 aa, Homo Sapiens
MTPSTLAPLE

SEQ ID NO: 510 - protein, 10 aa, Homo Sapiens
PWIMTPSTLA

SEQ ID NO: 511 - protein, 10 aa, Homo Sapiens
PSTLAPLEVY

SEQ ID NO: 512 - protein, 10 aa, Homo Sapiens
FLSFVPVPDG

SEQ ID NO: 513 - protein, 10 aa, Homo Sapiens
PVPDGKGFRM

SEQ ID NO: 514 - protein, 10 aa, Homo Sapiens
VPDGKGFRML

SEQ ID NO: 515 - protein, 10 aa, Homo Sapiens
FVPVPDGKGF

SEQ ID NO: 516 - protein, 10 aa, Homo Sapiens
VDEFLSFVPV

SEQ ID NO: 517 - protein, 10 aa, Homo Sapiens
LSFVPVPDGK

SEQ ID NO: 518 - protein, 10 aa, Homo Sapiens
DEFLSFVPVP

SEQ ID NO: 519 - protein, 10 aa, Homo Sapiens
VPVPDGKGFR

SEQ ID NO: 520 - protein, 10 aa, Homo Sapiens
SFVPVPDGKG

SEQ ID NO: 521 - protein, 10 aa, Homo Sapiens
EFLSFVPVPD

SEQ ID NO: 522 - protein, 9 aa, Homo Sapiens
KLVLHTSSY

SEQ ID NO: 523 - protein, 9 aa, Homo Sapiens
LVNMLVLGK

SEQ ID NO: 524 - protein, 9 aa, Homo Sapiens
ELQDFPYKR

SEQ ID NO: 525 - protein, 9 aa, Homo Sapiens
QLFKTERKK

SEQ ID NO: 526 - protein, 9 aa, Homo Sapiens
GVVDDEQVK

SEQ ID NO: 527 - protein, 9 aa, Homo Sapiens
GLSFPDAGF

SEQ ID NO: 528 - protein, 9 aa, Homo Sapiens
GLISFHVTL

SEQ ID NO: 529 - protein, 9 aa, Homo Sapiens
IIDIPQLFK

SEQ ID NO: 530 - protein, 9 aa, Homo Sapiens
SINQVLSNK

SEQ ID NO: 531 - protein, 9 aa, Homo Sapiens
RILGPDFGY

SEQ ID NO: 532 - protein, 9 aa, Homo Sapiens
KVQPPVELF

SEQ ID NO: 533 - protein, 9 aa, Homo Sapiens
VLGQDKVSY

SEQ ID NO: 534 - protein, 9 aa, Homo Sapiens
GVETLVDIY

SEQ ID NO: 535 - protein, 9 aa, Homo Sapiens
ACFKLFQEK

SEQ ID NO: 536 - protein, 9 aa, Homo Sapiens
KLFQEKQKC

SEQ ID NO: 537 - protein, 9 aa, Homo Sapiens
RLHGDEERF

SEQ ID NO: 538 - protein, 9 aa, Homo Sapiens
LLASPGACF

SEQ ID NO: 539 - protein, 9 aa, Homo Sapiens
VLYLTCVDI

SEQ ID NO: 540 - protein, 9 aa, Homo Sapiens
GILLVNCDR

SEQ ID NO: 541 - protein, 9 aa, Homo Sapiens
LLDDSNEDF

SEQ ID NO: 542 - protein, 9 aa, Homo Sapiens
NLPGSSGRR

SEQ ID NO: 543 - protein, 9 aa, Homo Sapiens
YLTCVDISL

SEQ ID NO: 544 - protein, 9 aa, Homo Sapiens
RQDRNFVDK

SEQ ID NO: 545 - protein, 9 aa, Homo Sapiens
ELARKAGCK

SEQ ID NO: 546 - protein, 9 aa, Homo Sapiens
STLPPLEVY

SEQ ID NO: 547 - protein, 9 aa, Homo Sapiens
VMNSPSNDL

SEQ ID NO: 548 - protein, 9 aa, Homo Sapiens
VCRKPFSFK

SEQ ID NO: 549 - protein, 9 aa, Homo Sapiens
GELQDFPYK

SEQ ID NO: 550 - protein, 9 aa, Homo Sapiens
HCGTNVCRK

SEQ ID NO: 551 - protein, 9 aa, Homo Sapiens
LLEPLGLHC

SEQ ID NO: 552 - protein, 9 aa, Homo Sapiens
VLHTSSYDA

SEQ ID NO: 553 - protein, 9 aa, Homo Sapiens
TICPQAENR

SEQ ID NO: 554 - protein, 9 aa, Homo Sapiens
NVCRKPFSF

SEQ ID NO: 555 - protein, 9 aa, Homo Sapiens
ELFVDWLAV

SEQ ID NO: 556 - protein, 9 aa, Homo Sapiens
HTSSYDAKR

SEQ ID NO: 557 - protein, 9 aa, Homo Sapiens
VQSCIDWNR

SEQ ID NO: 558 - protein, 9 aa, Homo Sapiens
KVSYEVPRL

SEQ ID NO: 559 - protein, 9 aa, Homo Sapiens
ALFDDHKLV

SEQ ID NO: 560 - protein, 9 aa, Homo Sapiens
VVFRVAPWI

SEQ ID NO: 561 - protein, 9 aa, Homo Sapiens
NMLVLGKHL

SEQ ID NO: 562 - protein, 9 aa, Homo Sapiens
GTPGVDIYI

SEQ ID NO: 563 - protein, 9 aa, Homo Sapiens
GLHCTFIDD

SEQ ID NO: 564 - protein, 9 aa, Homo Sapiens
IQDEMELGY

SEQ ID NO: 565 - protein, 9 aa, Homo Sapiens
PLAYAVLYL

SEQ ID NO: 566 - protein, 9 aa, Homo Sapiens
SLLEPLGLH

SEQ ID NO: 567 - protein, 9 aa, Homo Sapiens
SLEHPTSAV

SEQ ID NO: 568 - protein, 9 aa, Homo Sapiens
TLPPLEVYV

SEQ ID NO: 569 - protein, 9 aa, Homo Sapiens
LASPGACFK

SEQ ID NO: 570 - protein, 9 aa, Homo Sapiens
LLFQGVVDD

SEQ ID NO: 571 - protein, 9 aa, Homo Sapiens
RMLLASPGA

SEQ ID NO: 572 - protein, 9 aa, Homo Sapiens
HMLHGEVHC

SEQ ID NO: 573 - protein, 9 aa, Homo Sapiens
SVPEGTEMF

SEQ ID NO: 574 - protein, 9 aa, Homo Sapiens
SPPVVANGK

SEQ ID NO: 575 - protein, 9 aa, Homo Sapiens
ILGPDFGYV

SEQ ID NO: 576 - protein, 9 aa, Homo Sapiens
CLEEKVRSL

SEQ ID NO: 577 - protein, 9 aa, Homo Sapiens
KVRSLLEPL

SEQ ID NO: 578 - protein, 9 aa, Homo Sapiens
LVLGKHLGI

SEQ ID NO: 579 - protein, 9 aa, Homo Sapiens
GIPKPFGPI

SEQ ID NO: 580 - protein, 9 aa, Homo Sapiens
RTQGPAALF

SEQ ID NO: 581 - protein, 9 aa, Homo Sapiens
KTISINQVL

SEQ ID NO: 582 - protein, 9 aa, Homo Sapiens
VLRTQGPAA

SEQ ID NO: 583 - protein, 9 aa, Homo Sapiens
NLEVSPPVV

SEQ ID NO: 584 - protein, 9 aa, Homo Sapiens
NMERGRERA

SEQ ID NO: 585 - protein, 9 aa, Homo Sapiens
KTLPVVFDS

SEQ ID NO: 586 - protein, 9 aa, Homo Sapiens
LPLAYAVLY

SEQ ID NO: 587 - protein, 9 aa, Homo Sapiens
ELGLAECDI

SEQ ID NO: 588 - protein, 9 aa, Homo Sapiens
QVVRDFLHA

SEQ ID NO: 589 - protein, 9 aa, Homo Sapiens
GPEDVCEAY

SEQ ID NO: 590 - protein, 9 aa, Homo Sapiens
LISFHVTLL

SEQ ID NO: 591 - protein, 9 aa, Homo Sapiens
DLNDSHVQI

SEQ ID NO: 592 - protein, 9 aa, Homo Sapiens
DMSVMVLRT

SEQ ID NO: 593 - protein, 9 aa, Homo Sapiens
PLEVYVCRV

SEQ ID NO: 594 - protein, 9 aa, Homo Sapiens
GLAECDIID

SEQ ID NO: 595 - protein, 9 aa, Homo Sapiens
LPVVFDSPR

SEQ ID NO: 596 - protein, 9 aa, Homo Sapiens
GLDSFGNLE

SEQ ID NO: 597 - protein, 9 aa, Homo Sapiens
KATAFFPDL

SEQ ID NO: 598 - protein, 9 aa, Homo Sapiens
GTNVCRKPF

SEQ ID NO: 599 - protein, 9 aa, Homo Sapiens
HVDEFLSFV

SEQ ID NO: 600 - protein, 9 aa, Homo Sapiens
DLINYNKFV

SEQ ID NO: 601 - protein, 9 aa, Homo Sapiens
TLVDIYGSV

SEQ ID NO: 602 - protein, 9 aa, Homo Sapiens
DIIDIPQLF

SEQ ID NO: 603 - protein, 9 aa, Homo Sapiens
DAVAELARK

SEQ ID NO: 604 - protein, 9 aa, Homo Sapiens
FTDTVVFRV

SEQ ID NO: 605 - protein, 9 aa, Homo Sapiens
LAVGHVDEF

SEQ ID NO: 606 - protein, 9 aa, Homo Sapiens
GPDFGYVTR

SEQ ID NO: 607 - protein, 9 aa, Homo Sapiens
IPQLFKTER

SEQ ID NO: 608 - protein, 9 aa, Homo Sapiens
LGYVQAPHK

SEQ ID NO: 609 - protein, 9 aa, Homo Sapiens
IDWNREVLK

SEQ ID NO: 610 - protein, 9 aa, Homo Sapiens
PIFTDTVVF

SEQ ID NO: 611 - protein, 9 aa, Homo Sapiens
PQLFKTERK

SEQ ID NO: 612 - protein, 9 aa, Homo Sapiens
NKDLINYNK

SEQ ID NO: 613 - protein, 9 aa, Homo Sapiens
ILIGGNLPG

SEQ ID NO: 614 - protein, 9 aa, Homo Sapiens
TVVFRVAPW

SEQ ID NO: 615 - protein, 9 aa, Homo Sapiens
TLPVVFDSP

SEQ ID NO: 616 - protein, 9 aa, Homo Sapiens
AVGHVDEFL

SEQ ID NO: 617 - protein, 9 aa, Homo Sapiens
ELGYVQAPH

SEQ ID NO: 618 - protein, 9 aa, Homo Sapiens
RVTQVVRDF

SEQ ID NO: 619 - protein, 9 aa, Homo Sapiens
RIVRVSLEH

SEQ ID NO: 620 - protein, 9 aa, Homo Sapiens
QVLSNKDLI

SEQ ID NO: 621 - protein, 9 aa, Homo Sapiens
VLKRELGLA

SEQ ID NO: 622 - protein, 9 aa, Homo Sapiens
STLAPLEVY

SEQ ID NO: 623 - protein, 9 aa, Homo Sapiens
TLAPLEVYV

SEQ ID NO: 624 - protein, 9 aa, Homo Sapiens
APLEVYVCR

SEQ ID NO: 625 - protein, 9 aa, Homo Sapiens
IMTPSTLAP

SEQ ID NO: 626 - protein, 9 aa, Homo Sapiens
WIMTPSTLA

SEQ ID NO: 627 - protein, 9 aa, Homo Sapiens
MTPSTLAPL

SEQ ID NO: 628 - protein, 9 aa, Homo Sapiens
LAPLEVYVC

SEQ ID NO: 629 - protein, 9 aa, Homo Sapiens
TPSTLAPLE

SEQ ID NO: 630 - protein, 9 aa, Homo Sapiens
PSTLAPLEV

SEQ ID NO: 631 - protein, 9 aa, Homo Sapiens
SFVPVPDGK

SEQ ID NO: 632 - protein, 9 aa, Homo Sapiens
FLSFVPVPD

SEQ ID NO: 633 - protein, 9 aa, Homo Sapiens
VPVPDGKGF

SEQ ID NO: 634 - protein, 9 aa, Homo Sapiens
PVPDGKGFR

SEQ ID NO: 635 - protein, 9 aa, Homo Sapiens
VPDGKGFRM

SEQ ID NO: 636 - protein, 9 aa, Homo Sapiens
DEFLSFVPV

SEQ ID NO: 637 - protein, 9 aa, Homo Sapiens
LSFVPVPDG

SEQ ID NO: 638 - protein, 9 aa, Homo Sapiens
FVPVPDGKG

SEQ ID NO: 639 - protein, 9 aa, Homo Sapiens
EFLSFVPVP

SEQ ID NO: 640 - protein, 10 aa, Homo Sapiens
DLVNMLVLGK

SEQ ID NO: 641 - protein, 10 aa, Homo Sapiens
VLGKHLGIPK

SEQ ID NO: 642 - protein, 10 aa, Homo Sapiens
GLHCTFIDDF

SEQ ID NO: 643 - protein, 10 aa, Homo Sapiens
LLASPGACFK

SEQ ID NO: 644 - protein, 10 aa, Homo Sapiens
VLHTSSYDAK

SEQ ID NO: 645 - protein, 10 aa, Homo Sapiens
TLPVVFDSPR

SEQ ID NO: 646 - protein, 10 aa, Homo Sapiens
VLSNKDLINY

SEQ ID NO: 647 - protein, 10 aa, Homo Sapiens
NVCRKPFSFK

SEQ ID NO: 648 - protein, 10 aa, Homo Sapiens
GLAECDIIDI

SEQ ID NO: 649 - protein, 10 aa, Homo Sapiens
GLISFHVTLL

SEQ ID NO: 650 - protein, 10 aa, Homo Sapiens
ALFDDHKLVL

SEQ ID NO: 651 - protein, 10 aa, Homo Sapiens
WLAVGHVDEF

SEQ ID NO: 652 - protein, 10 aa, Homo Sapiens
ELGYVQAPHK

SEQ ID NO: 653 - protein, 10 aa, Homo Sapiens
MLLASPGACF

SEQ ID NO: 654 - protein, 10 aa, Homo Sapiens
TLLDDSNEDF

SEQ ID NO: 655 - protein, 10 aa, Homo Sapiens
CTFIDDFTPY

SEQ ID NO: 656 - protein, 10 aa, Homo Sapiens
DIIDIPQLFK

SEQ ID NO: 657 - protein, 10 aa, Homo Sapiens
TLPPLEVYVC

SEQ ID NO: 658 - protein, 10 aa, Homo Sapiens
VVRDFLHAQK

SEQ ID NO: 659 - protein, 10 aa, Homo Sapiens
CIDWNREVLK

SEQ ID NO: 660 - protein, 10 aa, Homo Sapiens
MLVLGKHLGI

SEQ ID NO: 661 - protein, 10 aa, Homo Sapiens
GPAALFDDHK

SEQ ID NO: 662 - protein, 10 aa, Homo Sapiens
DIYISPNMER

SEQ ID NO: 663 - protein, 10 aa, Homo Sapiens
GACFKLFQEK

SEQ ID NO: 664 - protein, 10 aa, Homo Sapiens
FVQSCIDWNR

SEQ ID NO: 665 - protein, 10 aa, Homo Sapiens
CLEEKVRSLL

SEQ ID NO: 666 - protein, 10 aa, Homo Sapiens
IMTPSTLPPL

SEQ ID NO: 667 - protein, 10 aa, Homo Sapiens
ILGPDFGYVT

SEQ ID NO: 668 - protein, 10 aa, Homo Sapiens
DLNCEGRQDR

SEQ ID NO: 669 - protein, 10 aa, Homo Sapiens
PLPLAYAVLY

SEQ ID NO: 670 - protein, 10 aa, Homo Sapiens
GLDSFGNLEV

SEQ ID NO: 671 - protein, 10 aa, Homo Sapiens
DLEDMSVMVL

SEQ ID NO: 672 - protein, 10 aa, Homo Sapiens
RQDRNFVDKR

SEQ ID NO: 673 - protein, 10 aa, Homo Sapiens
SLLEPLGLHC

SEQ ID NO: 674 - protein, 10 aa, Homo Sapiens
HVLGQDKVSY

SEQ ID NO: 675 - protein, 10 aa, Homo Sapiens
SLQRIVRVSL

SEQ ID NO: 676 - protein, 10 aa, Homo Sapiens
WIQDEMELGY

SEQ ID NO: 677 - protein, 10 aa, Homo Sapiens
FVDAVAELAR

SEQ ID NO: 678 - protein, 10 aa, Homo Sapiens
VLRTQGPAAL

SEQ ID NO: 679 - protein, 10 aa, Homo Sapiens
PIFTDTVVFR

SEQ ID NO: 680 - protein, 10 aa, Homo Sapiens
VLYLTCVDIS

SEQ ID NO: 681 - protein, 10 aa, Homo Sapiens
RQWVWGPSGY

SEQ ID NO: 682 - protein, 10 aa, Homo Sapiens
GIPKPFGPII

SEQ ID NO: 683 - protein, 10 aa, Homo Sapiens
LSFVPAPDGK

SEQ ID NO: 684 - protein, 10 aa, Homo Sapiens
QLFKTERKKA

SEQ ID NO: 685 - protein, 10 aa, Homo Sapiens
GELQDFPYKR

SEQ ID NO: 686 - protein, 10 aa, Homo Sapiens
LLFQGVVDDE

SEQ ID NO: 687 - protein, 10 aa, Homo Sapiens
CLQDLEDMSV

SEQ ID NO: 688 - protein, 10 aa, Homo Sapiens
DIPQLFKTER

SEQ ID NO: 689 - protein, 10 aa, Homo Sapiens
TLEIIVVMNS

SEQ ID NO: 690 - protein, 10 aa, Homo Sapiens
ISINQVLSNK

SEQ ID NO: 691 - protein, 10 aa, Homo Sapiens
VVFRVAPWIM

SEQ ID NO: 692 - protein, 10 aa, Homo Sapiens
RLHGDEERFF

SEQ ID NO: 693 - protein, 10 aa, Homo Sapiens
LTICPQAENR

SEQ ID NO: 694 - protein, 10 aa, Homo Sapiens
KTERKKATAF

SEQ ID NO: 695 - protein, 10 aa, Homo Sapiens
NLEVSPPVVA

SEQ ID NO: 696 - protein, 10 aa, Homo Sapiens
KVQPPVELFV

SEQ ID NO: 697 - protein, 10 aa, Homo Sapiens
MLHGEVHCGT

SEQ ID NO: 698 - protein, 10 aa, Homo Sapiens
VSPPVVANGK

SEQ ID NO: 699 - protein, 10 aa, Homo Sapiens
LLEPLGLHCT

SEQ ID NO: 700 - protein, 10 aa, Homo Sapiens
EVYGTPGVDI

SEQ ID NO: 701 - protein, 10 aa, Homo Sapiens
IPQLFKTERK

SEQ ID NO: 702 - protein, 10 aa, Homo Sapiens
SLEHPTSAVC

SEQ ID NO: 703 - protein, 10 aa, Homo Sapiens
GRQDRNFVDK

SEQ ID NO: 704 - protein, 10 aa, Homo Sapiens
SNKDLINYNK

SEQ ID NO: 705 - protein, 10 aa, Homo Sapiens
ELGLAECDII

SEQ ID NO: 706 - protein, 10 aa, Homo Sapiens
ELARKAGCKL

SEQ ID NO: 707 - protein, 10 aa, Homo Sapiens
VVANGKEYPL

SEQ ID NO: 708 - protein, 10 aa, Homo Sapiens
AVCVAGVETL

SEQ ID NO: 709 - protein, 10 aa, Homo Sapiens
KLFQEKQKCG

SEQ ID NO: 710 - protein, 10 aa, Homo Sapiens
ELFVDWLAVG

SEQ ID NO: 711 - protein, 10 aa, Homo Sapiens
EMFEVYGTPG

SEQ ID NO: 712 - protein, 10 aa, Homo Sapiens
ELQDFPYKRI

SEQ ID NO: 713 - protein, 10 aa, Homo Sapiens
GTEMFEVYGT

SEQ ID NO: 714 - protein, 10 aa, Homo Sapiens
VVMNSPSNDL

SEQ ID NO: 715 - protein, 10 aa, Homo Sapiens
TVVFRVAPWI

SEQ ID NO: 716 - protein, 10 aa, Homo Sapiens
ILIGGNLPGS

SEQ ID NO: 717 - protein, 10 aa, Homo Sapiens
IDWNREVLKR

SEQ ID NO: 718 - protein, 10 aa, Homo Sapiens
GPEDVCEAYR

SEQ ID NO: 719 - protein, 10 aa, Homo Sapiens
EVHCGTNVCR

SEQ ID NO: 720 - protein, 10 aa, Homo Sapiens
KCGHGRALLF

SEQ ID NO: 721 - protein, 10 aa, Homo Sapiens
KPFGPIINGC

SEQ ID NO: 722 - protein, 10 aa, Homo Sapiens
FVPAPDGKGF

SEQ ID NO: 723 - protein, 10 aa, Homo Sapiens
VHCGTNVCRK

SEQ ID NO: 724 - protein, 10 aa, Homo Sapiens
KLTICPQAEN

SEQ ID NO: 725 - protein, 10 aa, Homo Sapiens
GVDIYISPNM

SEQ ID NO: 726 - protein, 10 aa, Homo Sapiens
VVDDEQVKTI

SEQ ID NO: 727 - protein, 10 aa, Homo Sapiens
KPFSFKWWNM

SEQ ID NO: 728 - protein, 10 aa, Homo Sapiens
VMVLRTQGPA

SEQ ID NO: 729 - protein, 10 aa, Homo Sapiens
TCFVDAVAEL

SEQ ID NO: 730 - protein, 10 aa, Homo Sapiens
TLVDIYGSVP

SEQ ID NO: 731 - protein, 10 aa, Homo Sapiens
KLVLHTSSYD

SEQ ID NO: 732 - protein, 10 aa, Homo Sapiens
RVTQVVRDFL

SEQ ID NO: 733 - protein, 10 aa, Homo Sapiens
RMLLASPGAC

SEQ ID NO: 734 - protein, 10 aa, Homo Sapiens
FVEGLSFPDA

SEQ ID NO: 735 - protein, 10 aa, Homo Sapiens
LVLHTSSYDA

SEQ ID NO: 736 - protein, 10 aa, Homo Sapiens
ALLFQGVVDD

SEQ ID NO: 737 - protein, 10 aa, Homo Sapiens
GLSFPDAGFT

SEQ ID NO: 738 - protein, 10 aa, Homo Sapiens
AVLYLTCVDI

SEQ ID NO: 739 - protein, 10 aa, Homo Sapiens
HMLHGEVHCG

SEQ ID NO: 740 - protein, 10 aa, Homo Sapiens
TLAPLEVYVC

SEQ ID NO: 741 - protein, 10 aa, Homo Sapiens
IMTPSTLAPL

SEQ ID NO: 742 - protein, 10 aa, Homo Sapiens
LAPLEVYVCR

SEQ ID NO: 743 - protein, 10 aa, Homo Sapiens
APLEVYVCRV

SEQ ID NO: 744 - protein, 10 aa, Homo Sapiens
STLAPLEVYV

SEQ ID NO: 745 - protein, 10 aa, Homo Sapiens
WIMTPSTLAP

SEQ ID NO: 746 - protein, 10 aa, Homo Sapiens
PSTLAPLEVY

SEQ ID NO: 747 - protein, 10 aa, Homo Sapiens
TPSTLAPLEV

SEQ ID NO: 748 - protein, 10 aa, Homo Sapiens
MTPSTLAPLE

SEQ ID NO: 749 - protein, 10 aa, Homo Sapiens
PWIMTPSTLA

SEQ ID NO: 750 - protein, 10 aa, Homo Sapiens
LSFVPVPDGK

SEQ ID NO: 751 - protein, 10 aa, Homo Sapiens
FVPVPDGKGF

SEQ ID NO: 752 - protein, 10 aa, Homo Sapiens
FLSFVPVPDG

SEQ ID NO: 753 - protein, 10 aa, Homo Sapiens
VPVPDGKGFR

SEQ ID NO: 754 - protein, 10 aa, Homo Sapiens
PVPDGKGFRM

SEQ ID NO: 755 - protein, 10 aa, Homo Sapiens
VPDGKGFRML

SEQ ID NO: 756 - protein, 10 aa, Homo Sapiens
DEFLSFVPVP

SEQ ID NO: 757 - protein, 10 aa, Homo Sapiens
VDEFLSFVPV

SEQ ID NO: 758 - protein, 10 aa, Homo Sapiens
SFVPVPDGKG

SEQ ID NO: 759 - protein, 10 aa, Homo Sapiens
EFLSFVPVPD

SEQ ID NO: 760 - protein, 9 aa, Homo Sapiens
GVVDDEQVK

SEQ ID NO: 761 - protein, 9 aa, Homo Sapiens
LVNMLVLGK

SEQ ID NO: 762 - protein, 9 aa, Homo Sapiens
RQDRNFVDK

SEQ ID NO: 763 - protein, 9 aa, Homo Sapiens
IIDIPQLFK

SEQ ID NO: 764 - protein, 9 aa, Homo Sapiens
ACFKLFQEK

SEQ ID NO: 765 - protein, 9 aa, Homo Sapiens
SINQVLSNK

SEQ ID NO: 766 - protein, 9 aa, Homo Sapiens
GILLVNCDR

SEQ ID NO: 767 - protein, 9 aa, Homo Sapiens
SFVPAPDGK

SEQ ID NO: 768 - protein, 9 aa, Homo Sapiens
GELQDFPYK

SEQ ID NO: 769 - protein, 9 aa, Homo Sapiens
IYISPNMER

SEQ ID NO: 770 - protein, 9 aa, Homo Sapiens
VQSCIDWNR

SEQ ID NO: 771 - protein, 9 aa, Homo Sapiens
HTSSYDAKR

SEQ ID NO: 772 - protein, 9 aa, Homo Sapiens
LASPGACFK

SEQ ID NO: 773 - protein, 9 aa, Homo Sapiens
HCGTNVCRK

SEQ ID NO: 774 - protein, 9 aa, Homo Sapiens
VCRKPFSFK

SEQ ID NO: 775 - protein, 9 aa, Homo Sapiens
SPPVVANGK

SEQ ID NO: 776 - protein, 9 aa, Homo Sapiens
ELARKAGCK

SEQ ID NO: 777 - protein, 9 aa, Homo Sapiens
GPDFGYVTR

SEQ ID NO: 778 - protein, 9 aa, Homo Sapiens
PQLFKTERK

SEQ ID NO: 779 - protein, 9 aa, Homo Sapiens
DAVAELARK

SEQ ID NO: 780 - protein, 9 aa, Homo Sapiens
QLFKTERKK

SEQ ID NO: 781 - protein, 9 aa, Homo Sapiens
TICPQAENR

SEQ ID NO: 782 - protein, 9 aa, Homo Sapiens
NLPGSSGRR

SEQ ID NO: 783 - protein, 9 aa, Homo Sapiens
GVETLVDIY

SEQ ID NO: 784 - protein, 9 aa, Homo Sapiens
RVRNNTCFV

SEQ ID NO: 785 - protein, 9 aa, Homo Sapiens
NVCRKPFSF

SEQ ID NO: 786 - protein, 9 aa, Homo Sapiens
QVVRDFLHA

SEQ ID NO: 787 - protein, 9 aa, Homo Sapiens
KVRSLLEPL

SEQ ID NO: 788 - protein, 9 aa, Homo Sapiens
LPVVFDSPR

SEQ ID NO: 789 - protein, 9 aa, Homo Sapiens
GTPGVDIYI

SEQ ID NO: 790 - protein, 9 aa, Homo Sapiens
KVQPPVELF

SEQ ID NO: 791 - protein, 9 aa, Homo Sapiens
LVLGKHLGI

SEQ ID NO: 792 - protein, 9 aa, Homo Sapiens
KVSYEVPRL

SEQ ID NO: 793 - protein, 9 aa, Homo Sapiens
RILGPDFGY

SEQ ID NO: 794 - protein, 9 aa, Homo Sapiens
ELQDFPYKR

SEQ ID NO: 795 - protein, 9 aa, Homo Sapiens
KTISINQVL

SEQ ID NO: 796 - protein, 9 aa, Homo Sapiens
LGYVQAPHK

SEQ ID NO: 797 - protein, 9 aa, Homo Sapiens
IFTDTVVFR

SEQ ID NO: 798 - protein, 9 aa, Homo Sapiens
YVTREPRDR

SEQ ID NO: 799 - protein, 9 aa, Homo Sapiens
VVFRVAPWI

SEQ ID NO: 800 - protein, 9 aa, Homo Sapiens
LGKHLGIPK

SEQ ID NO: 801 - protein, 9 aa, Homo Sapiens
FVDKRQWVW

SEQ ID NO: 802 - protein, 9 aa, Homo Sapiens
IDWNREVLK

SEQ ID NO: 803 - protein, 9 aa, Homo Sapiens
IPQLFKTER

SEQ ID NO: 804 - protein, 9 aa, Homo Sapiens
NKDLINYNK

SEQ ID NO: 805 - protein, 9 aa, Homo Sapiens
GNLPGSSGR

SEQ ID NO: 806 - protein, 9 aa, Homo Sapiens
GQDKVSYEV

SEQ ID NO: 807 - protein, 9 aa, Homo Sapiens
RIVRVSLEH

SEQ ID NO: 808 - protein, 9 aa, Homo Sapiens
TVVFRVAPW

SEQ ID NO: 809 - protein, 9 aa, Homo Sapiens
QVLSNKDLI

SEQ ID NO: 810 - protein, 9 aa, Homo Sapiens
FTDTVVFRV

SEQ ID NO: 811 - protein, 9 aa, Homo Sapiens
MVLRTQGPA

SEQ ID NO: 812 - protein, 9 aa, Homo Sapiens
RTQGPAALF

SEQ ID NO: 813 - protein, 9 aa, Homo Sapiens
KTERKKATA

SEQ ID NO: 814 - protein, 9 aa, Homo Sapiens
FTGLISFHV

SEQ ID NO: 815 - protein, 9 aa, Homo Sapiens
TQVVRDFLH

SEQ ID NO: 816 - protein, 9 aa, Homo Sapiens
RFFVEGLSF

SEQ ID NO: 817 - protein, 9 aa, Homo Sapiens
LHTSSYDAK

SEQ ID NO: 818 - protein, 9 aa, Homo Sapiens
FVDWLAVGH

SEQ ID NO: 819 - protein, 9 aa, Homo Sapiens
AVGHVDEFL

SEQ ID NO: 820 - protein, 9 aa, Homo Sapiens
FVDAVAELA

SEQ ID NO: 821 - protein, 9 aa, Homo Sapiens
YRHVLGQDK

SEQ ID NO: 822 - protein, 9 aa, Homo Sapiens
SVPEGTEMF

SEQ ID NO: 823 - protein, 9 aa, Homo Sapiens
CVAGVETLV

SEQ ID NO: 824 - protein, 9 aa, Homo Sapiens
HVDEFLSFV

SEQ ID NO: 825 - protein, 9 aa, Homo Sapiens
CCCLEEKVR

SEQ ID NO: 826 - protein, 9 aa, Homo Sapiens
VRDFLHAQK

SEQ ID NO: 827 - protein, 9 aa, Homo Sapiens
NGCCCLEEK

SEQ ID NO: 828 - protein, 9 aa, Homo Sapiens
PAALFDDHK

SEQ ID NO: 829 - protein, 9 aa, Homo Sapiens
KQKCGHGRA

SEQ ID NO: 830 - protein, 9 aa, Homo Sapiens
RMLLASPGA

SEQ ID NO: 831 - protein, 9 aa, Homo Sapiens
GLISFHVTL

SEQ ID NO: 832 - protein, 9 aa, Homo Sapiens
KLVLHTSSY

SEQ ID NO: 833 - protein, 9 aa, Homo Sapiens
KFVQSCIDW

SEQ ID NO: 834 - protein, 9 aa, Homo Sapiens
EVLKRELGL

SEQ ID NO: 835 - protein, 9 aa, Homo Sapiens
FKLFQEKQK

SEQ ID NO: 836 - protein, 9 aa, Homo Sapiens
GTNVCRKPF

SEQ ID NO: 837 - protein, 9 aa, Homo Sapiens
STLPPLEVY

SEQ ID NO: 838 - protein, 9 aa, Homo Sapiens
ATLEIIVVM

SEQ ID NO: 839 - protein, 9 aa, Homo Sapiens
KTLPVVFDS

SEQ ID NO: 840 - protein, 9 aa, Homo Sapiens
GRERADTRR

SEQ ID NO: 841 - protein, 9 aa, Homo Sapiens
PQAENRNDR

SEQ ID NO: 842 - protein, 9 aa, Homo Sapiens
RGRERADTR

SEQ ID NO: 843 - protein, 9 aa, Homo Sapiens
GRRVTQVVR

SEQ ID NO: 844 - protein, 9 aa, Homo Sapiens
IQDEMELGY

SEQ ID NO: 845 - protein, 9 aa, Homo Sapiens
DCDLNCEGR

SEQ ID NO: 846 - protein, 9 aa, Homo Sapiens
RLHGDEERF

SEQ ID NO: 847 - protein, 9 aa, Homo Sapiens
GIPKPFGPI

SEQ ID NO: 848 - protein, 9 aa, Homo Sapiens
RADTRRWRF

SEQ ID NO: 849 - protein, 9 aa, Homo Sapiens
LQDLEDMSV

SEQ ID NO: 850 - protein, 9 aa, Homo Sapiens
RVAPWIMTP

SEQ ID NO: 851 - protein, 9 aa, Homo Sapiens
GLSFPDAGF

SEQ ID NO: 852 - protein, 9 aa, Homo Sapiens
VQPPVELFV

SEQ ID NO: 853 - protein, 9 aa, Homo Sapiens
MTPSTLPPL

SEQ ID NO: 854 - protein, 9 aa, Homo Sapiens
ATAFFPDLV

SEQ ID NO: 855 - protein, 9 aa, Homo Sapiens
NTCFVDAVA

SEQ ID NO: 856 - protein, 9 aa, Homo Sapiens
YVQAPHKTL

SEQ ID NO: 857 - protein, 9 aa, Homo Sapiens
VTQVVRDFL

SEQ ID NO: 858 - protein, 9 aa, Homo Sapiens
RALLFQGVV

SEQ ID NO: 859 - protein, 9 aa, Homo Sapiens
DTRRWRFDA

SEQ ID NO: 860 - protein, 9 aa, Homo Sapiens
APLEVYVCR

SEQ ID NO: 861 - protein, 9 aa, Homo Sapiens
STLAPLEVY

SEQ ID NO: 862 - protein, 9 aa, Homo Sapiens
MTPSTLAPL

SEQ ID NO: 863 - protein, 9 aa, Homo Sapiens
WIMTPSTLA

SEQ ID NO: 864 - protein, 9 aa, Homo Sapiens
TLAPLEVYV

SEQ ID NO: 865 - protein, 9 aa, Homo Sapiens
IMTPSTLAP

SEQ ID NO: 866 - protein, 9 aa, Homo Sapiens
LAPLEVYVC

SEQ ID NO: 867 - protein, 9 aa, Homo Sapiens
TPSTLAPLE

SEQ ID NO: 868 - protein, 9 aa, Homo Sapiens
PSTLAPLEV

SEQ ID NO: 869 - protein, 9 aa, Homo Sapiens
SFVPVPDGK

SEQ ID NO: 870 - protein, 9 aa, Homo Sapiens
PVPDGKGFR

SEQ ID NO: 871 - protein, 9 aa, Homo Sapiens
VPDGKGFRM

SEQ ID NO: 872 - protein, 9 aa, Homo Sapiens
FVPVPDGKG

SEQ ID NO: 873 - protein, 9 aa, Homo Sapiens
VPVPDGKGF

SEQ ID NO: 874 - protein, 9 aa, Homo Sapiens
FLSFVPVPD

SEQ ID NO: 875 - protein, 9 aa, Homo Sapiens
DEFLSFVPV

SEQ ID NO: 876 - protein, 9 aa, Homo Sapiens
EFLSFVPVP

SEQ ID NO: 877 - protein, 9 aa, Homo Sapiens
LSFVPVPDG

SEQ ID NO: 878 - protein, 10 aa, Homo Sapiens
VVRDFLHAQK

SEQ ID NO: 879 - protein, 10 aa, Homo Sapiens
NVCRKPFSFK

SEQ ID NO: 880 - protein, 10 aa, Homo Sapiens
VLGKHLGIPK

SEQ ID NO: 881 - protein, 10 aa, Homo Sapiens
FVQSCIDWNR

SEQ ID NO: 882 - protein, 10 aa, Homo Sapiens
FVDAVAELAR

SEQ ID NO: 883 - protein, 10 aa, Homo Sapiens
GPAALFDDHK

SEQ ID NO: 884 - protein, 10 aa, Homo Sapiens
GACFKLFQEK

SEQ ID NO: 885 - protein, 10 aa, Homo Sapiens
VLHTSSYDAK

SEQ ID NO: 886 - protein, 10 aa, Homo Sapiens
LLASPGACFK

SEQ ID NO: 887 - protein, 10 aa, Homo Sapiens
AYRHVLGQDK

SEQ ID NO: 888 - protein, 10 aa, Homo Sapiens
CIDWNREVLK

SEQ ID NO: 889 - protein, 10 aa, Homo Sapiens
RQDRNFVDKR

SEQ ID NO: 890 - protein, 10 aa, Homo Sapiens
DIIDIPQLFK

SEQ ID NO: 891 - protein, 10 aa, Homo Sapiens
DLVNMLVLGK

SEQ ID NO: 892 - protein, 10 aa, Homo Sapiens
LTICPQAENR

SEQ ID NO: 893 - protein, 10 aa, Homo Sapiens
IPQLFKTERK

SEQ ID NO: 894 - protein, 10 aa, Homo Sapiens
GPEDVCEAYR

SEQ ID NO: 895 - protein, 10 aa, Homo Sapiens
KVQPPVELFV

SEQ ID NO: 896 - protein, 10 aa, Homo Sapiens
EVHCGTNVCR

SEQ ID NO: 897 - protein, 10 aa, Homo Sapiens
ELGYVQAPHK

SEQ ID NO: 898 - protein, 10 aa, Homo Sapiens
GELQDFPYKR

SEQ ID NO: 899 - protein, 10 aa, Homo Sapiens
CFKLFQEKQK

SEQ ID NO: 900 - protein, 10 aa, Homo Sapiens
DIYISPNMER

SEQ ID NO: 901 - protein, 10 aa, Homo Sapiens
AELARKAGCK

SEQ ID NO: 902 - protein, 10 aa, Homo Sapiens
TLPVVFDSPR

SEQ ID NO: 903 - protein, 10 aa, Homo Sapiens
VVFRVAPWIM

SEQ ID NO: 904 - protein, 10 aa, Homo Sapiens
SNKDLINYNK

SEQ ID NO: 905 - protein, 10 aa, Homo Sapiens
GRQDRNFVDK

SEQ ID NO: 906 - protein, 10 aa, Homo Sapiens
GCCCLEEKVR

SEQ ID NO: 907 - protein, 10 aa, Homo Sapiens
RVTQVVRDFL

SEQ ID NO: 908 - protein, 10 aa, Homo Sapiens
LVLHTSSYDA

SEQ ID NO: 909 - protein, 10 aa, Homo Sapiens
RVSLEHPTSA

SEQ ID NO: 910 - protein, 10 aa, Homo Sapiens
GVDIYISPNM

SEQ ID NO: 911 - protein, 10 aa, Homo Sapiens
VVMNSPSNDL

SEQ ID NO: 912 - protein, 10 aa, Homo Sapiens
VPAPDGKGFR

SEQ ID NO: 913 - protein, 10 aa, Homo Sapiens
VVANGKEYPL

SEQ ID NO: 914 - protein, 10 aa, Homo Sapiens
CPQAENRNDR

SEQ ID NO: 915 - protein, 10 aa, Homo Sapiens
INGCCCLEEK

SEQ ID NO: 916 - protein, 10 aa, Homo Sapiens
VPRLHGDEER

SEQ ID NO: 917 - protein, 10 aa, Homo Sapiens
LPPLEVYVCR

SEQ ID NO: 918 - protein, 10 aa, Homo Sapiens
LSFVPAPDGK

SEQ ID NO: 919 - protein, 10 aa, Homo Sapiens
GNLPGSSGRR

SEQ ID NO: 920 - protein, 10 aa, Homo Sapiens
GYVTREPRDR

SEQ ID NO: 921 - protein, 10 aa, Homo Sapiens
RQWVWGPSGY

SEQ ID NO: 922 - protein, 10 aa, Homo Sapiens
ISINQVLSNK

SEQ ID NO: 923 - protein, 10 aa, Homo Sapiens
QGVVDDEQVK

SEQ ID NO: 924 - protein, 10 aa, Homo Sapiens
HVLGQDKVSY

SEQ ID NO: 925 - protein, 10 aa, Homo Sapiens
AVLYLTCVDI

SEQ ID NO: 926 - protein, 10 aa, Homo Sapiens
VTQVVRDFLH

SEQ ID NO: 927 - protein, 10 aa, Homo Sapiens
KTERKKATAF

SEQ ID NO: 928 - protein, 10 aa, Homo Sapiens
TVVFRVAPWI

SEQ ID NO: 929 - protein, 10 aa, Homo Sapiens
MVLRTQGPAA

SEQ ID NO: 930 - protein, 10 aa, Homo Sapiens
DIPQLFKTER

SEQ ID NO: 931 - protein, 10 aa, Homo Sapiens
KPFSFKWWNM

SEQ ID NO: 932 - protein, 10 aa, Homo Sapiens
DLNCEGRQDR

SEQ ID NO: 933 - protein, 10 aa, Homo Sapiens
GLAECDIIDI

SEQ ID NO: 934 - protein, 10 aa, Homo Sapiens
GLDSFGNLEV

SEQ ID NO: 935 - protein, 10 aa, Homo Sapiens
CTFIDDFTPY

SEQ ID NO: 936 - protein, 10 aa, Homo Sapiens
QVKTISINQV

SEQ ID NO: 937 - protein, 10 aa, Homo Sapiens
VSPPVVANGK

SEQ ID NO: 938 - protein, 10 aa, Homo Sapiens
FVEGLSFPDA

SEQ ID NO: 939 - protein, 10 aa, Homo Sapiens
AVCVAGVETL

SEQ ID NO: 940 - protein, 10 aa, Homo Sapiens
CVDISLDCDL

SEQ ID NO: 941 - protein, 10 aa, Homo Sapiens
VHCGTNVCRK

SEQ ID NO: 942 - protein, 10 aa, Homo Sapiens
FVDWLAVGHV

SEQ ID NO: 943 - protein, 10 aa, Homo Sapiens
VDAVAELARK

SEQ ID NO: 944 - protein, 10 aa, Homo Sapiens
HVQISYHSSH

SEQ ID NO: 945 - protein, 10 aa, Homo Sapiens
LVNMLVLGKH

SEQ ID NO: 946 - protein, 10 aa, Homo Sapiens
NGELQDFPYK

SEQ ID NO: 947 - protein, 10 aa, Homo Sapiens
GGILLVNCDR

SEQ ID NO: 948 - protein, 10 aa, Homo Sapiens
TQVVRDFLHA

SEQ ID NO: 949 - protein, 10 aa, Homo Sapiens
RILGPDFGYV

SEQ ID NO: 950 - protein, 10 aa, Homo Sapiens
GLISFHVTLL

SEQ ID NO: 951 - protein, 10 aa, Homo Sapiens
GFTGLISFHV

SEQ ID NO: 952 - protein, 10 aa, Homo Sapiens
RVRNNTCFVD

SEQ ID NO: 953 - protein, 10 aa, Homo Sapiens
IDWNREVLKR

SEQ ID NO: 954 - protein, 10 aa, Homo Sapiens
ANGKEYPLGR

SEQ ID NO: 955 - protein, 10 aa, Homo Sapiens
ALFDDHKLVL

SEQ ID NO: 956 - protein, 10 aa, Homo Sapiens
PIFTDTVVFR

SEQ ID NO: 957 - protein, 10 aa, Homo Sapiens
STLPPLEVYV

SEQ ID NO: 958 - protein, 10 aa, Homo Sapiens
GGNLPGSSGR

SEQ ID NO: 959 - protein, 10 aa, Homo Sapiens
RGRERADTRR

SEQ ID NO: 960 - protein, 10 aa, Homo Sapiens
QEKQKCGHGR

SEQ ID NO: 961 - protein, 10 aa, Homo Sapiens
GIPKPFGPII

SEQ ID NO: 962 - protein, 10 aa, Homo Sapiens
GPSGYGGILL

SEQ ID NO: 963 - protein, 10 aa, Homo Sapiens
MLVLGKHLGI

SEQ ID NO: 964 - protein, 10 aa, Homo Sapiens
RFDATLEIIV

SEQ ID NO: 965 - protein, 10 aa, Homo Sapiens
VQAPHKTLPV

SEQ ID NO: 966 - protein, 10 aa, Homo Sapiens
GLHCTFIDDF

SEQ ID NO: 967 - protein, 10 aa, Homo Sapiens
EVYGTPGVDI

SEQ ID NO: 968 - protein, 10 aa, Homo Sapiens
LYLTCVDISL

SEQ ID NO: 969 - protein, 10 aa, Homo Sapiens
DFGYVTREPR

SEQ ID NO: 970 - protein, 10 aa, Homo Sapiens
LEDMSVMVLR

SEQ ID NO: 971 - protein, 10 aa, Homo Sapiens
GVETLVDIYG

SEQ ID NO: 972 - protein, 10 aa, Homo Sapiens
KCGHGRALLF

SEQ ID NO: 973 - protein, 10 aa, Homo Sapiens
FVPAPDGKGF

SEQ ID NO: 974 - protein, 10 aa, Homo Sapiens
VVDDEQVKTI

SEQ ID NO: 975 - protein, 10 aa, Homo Sapiens
PQLFKTERKK

SEQ ID NO: 976 - protein, 10 aa, Homo Sapiens
GVVDDEQVKT

SEQ ID NO: 977 - protein, 10 aa, Homo Sapiens
NQVLSNKDLI

SEQ ID NO: 978 - protein, 10 aa, Homo Sapiens
LAPLEVYVCR

SEQ ID NO: 979 - protein, 10 aa, Homo Sapiens
STLAPLEVYV

SEQ ID NO: 980 - protein, 10 aa, Homo Sapiens
TPSTLAPLEV

SEQ ID NO: 981 - protein, 10 aa, Homo Sapiens
IMTPSTLAPL

SEQ ID NO: 982 - protein, 10 aa, Homo Sapiens
APLEVYVCRV

SEQ ID NO: 983 - protein, 10 aa, Homo Sapiens
WIMTPSTLAP

SEQ ID NO: 984 - protein, 10 aa, Homo Sapiens
MTPSTLAPLE

SEQ ID NO: 985 - protein, 10 aa, Homo Sapiens
TLAPLEVYVC

SEQ ID NO: 986 - protein, 10 aa, Homo Sapiens
PWIMTPSTLA

SEQ ID NO: 987 - protein, 10 aa, Homo Sapiens
PSTLAPLEVY

SEQ ID NO: 988 - protein, 10 aa, Homo Sapiens
VPVPDGKGFR

SEQ ID NO: 989 - protein, 10 aa, Homo Sapiens
LSFVPVPDGK

SEQ ID NO: 990 - protein, 10 aa, Homo Sapiens
FVPVPDGKGF

SEQ ID NO: 991 - protein, 10 aa, Homo Sapiens
PVPDGKGFRM

SEQ ID NO: 992 - protein, 10 aa, Homo Sapiens
FLSFVPVPDG

SEQ ID NO: 993 - protein, 10 aa, Homo Sapiens
SFVPVPDGKG

SEQ ID NO: 994 - protein, 10 aa, Homo Sapiens
VPDGKGFRML

SEQ ID NO: 995 - protein, 10 aa, Homo Sapiens
VDEFLSFVPV

SEQ ID NO: 996 - protein, 10 aa, Homo Sapiens
EFLSFVPVPD

SEQ ID NO: 997 - protein, 10 aa, Homo Sapiens
DEFLSFVPVP

SEQ ID NO: 998 - protein, 9 aa, Homo Sapiens
SYHSSHEPL

SEQ ID NO: 999 - protein, 9 aa, Homo Sapiens
EYPLGRILI

SEQ ID NO: 1000 - protein, 9 aa, Homo Sapiens
FFPDLVNML

SEQ ID NO: 1001 - protein, 9 aa, Homo Sapiens
VYGTPGVDI

SEQ ID NO: 1002 - protein, 9 aa, Homo Sapiens
CFVDAVAEL

SEQ ID NO: 1003 - protein, 9 aa, Homo Sapiens
LFDDHKLVL

SEQ ID NO: 1004 - protein, 9 aa, Homo Sapiens
KTISINQVL

SEQ ID NO: 1005 - protein, 9 aa, Homo Sapiens
RFFVEGLSF

SEQ ID NO: 1006 - protein, 9 aa, Homo Sapiens
RWIQDEMEL

SEQ ID NO: 1007 - protein, 9 aa, Homo Sapiens
RSLLEPLGL

SEQ ID NO: 1008 - protein, 9 aa, Homo Sapiens
RFDATLEII

SEQ ID NO: 1009 - protein, 9 aa, Homo Sapiens
KATAFFPDL

SEQ ID NO: 1010 - protein, 9 aa, Homo Sapiens
KVRSLLEPL

SEQ ID NO: 1011 - protein, 9 aa, Homo Sapiens
NYNKFVQSC

SEQ ID NO: 1012 - protein, 9 aa, Homo Sapiens
SGLDSFGNL

SEQ ID NO: 1013 - protein, 9 aa, Homo Sapiens
VTQVVRDFL

SEQ ID NO: 1014 - protein, 9 aa, Homo Sapiens
GYVQAPHKT

SEQ ID NO: 1015 - protein, 9 aa, Homo Sapiens
KCGHGRALL

SEQ ID NO: 1016 - protein, 9 aa, Homo Sapiens
KVSYEVPRL

SEQ ID NO: 1017 - protein, 9 aa, Homo Sapiens
LYLTCVDIS

SEQ ID NO: 1018 - protein, 9 aa, Homo Sapiens
VYVCRVRNN

SEQ ID NO: 1019 - protein, 9 aa, Homo Sapiens
NMLVLGKHL

SEQ ID NO: 1020 - protein, 9 aa, Homo Sapiens
KVQPPVELF

SEQ ID NO: 1021 - protein, 9 aa, Homo Sapiens
VMNSPSNDL

SEQ ID NO: 1022 - protein, 9 aa, Homo Sapiens
CLEEKVRSL

SEQ ID NO: 1023 - protein, 9 aa, Homo Sapiens
GYGGILLVN

SEQ ID NO: 1024 - protein, 9 aa, Homo Sapiens
IYGSVPEGT

SEQ ID NO: 1025 - protein, 9 aa, Homo Sapiens
AALFDDHKL

SEQ ID NO: 1026 - protein, 9 aa, Homo Sapiens
ASPGACFKL

SEQ ID NO: 1027 - protein, 9 aa, Homo Sapiens
DIIDIPQLF

SEQ ID NO: 1028 - protein, 9 aa, Homo Sapiens
MTPSTLPPL

SEQ ID NO: 1029 - protein, 9 aa, Homo Sapiens
VANGKEYPL

SEQ ID NO: 1030 - protein, 9 aa, Homo Sapiens
EVLKRELGL

SEQ ID NO: 1031 - protein, 9 aa, Homo Sapiens
VCEAYRHVL

SEQ ID NO: 1032 - protein, 9 aa, Homo Sapiens
NQVLSNKDL

SEQ ID NO: 1033 - protein, 9 aa, Homo Sapiens
RTQGPAALF

SEQ ID NO: 1034 - protein, 9 aa, Homo Sapiens
GLISFHVTL

SEQ ID NO: 1035 - protein, 9 aa, Homo Sapiens
RSVSGLDSF

SEQ ID NO: 1036 - protein, 9 aa, Homo Sapiens
VCVAGVETL

SEQ ID NO: 1037 - protein, 9 aa, Homo Sapiens
YVQAPHKTL

SEQ ID NO: 1038 - protein, 9 aa, Homo Sapiens
AYAVLYLTC

SEQ ID NO: 1039 - protein, 9 aa, Homo Sapiens
YLTCVDISL

SEQ ID NO: 1040 - protein, 9 aa, Homo Sapiens
AVGHVDEFL

SEQ ID NO: 1041 - protein, 9 aa, Homo Sapiens
RVTQVVRDF

SEQ ID NO: 1042 - protein, 9 aa, Homo Sapiens
LQRIVRVSL

SEQ ID NO: 1043 - protein, 9 aa, Homo Sapiens
SYDAKRAQV

SEQ ID NO: 1044 - protein, 9 aa, Homo Sapiens
FPDAGFTGL

SEQ ID NO: 1045 - protein, 9 aa, Homo Sapiens
LARKAGCKL

SEQ ID NO: 1046 - protein, 9 aa, Homo Sapiens
DGKGFRMLL

SEQ ID NO: 1047 - protein, 9 aa, Homo Sapiens
RADTRRWRF

SEQ ID NO: 1048 - protein, 9 aa, Homo Sapiens
LISFHVTLL

SEQ ID NO: 1049 - protein, 9 aa, Homo Sapiens
CIDWNREVL

SEQ ID NO: 1050 - protein, 9 aa, Homo Sapiens
HSSHEPLPL

SEQ ID NO: 1051 - protein, 9 aa, Homo Sapiens
RLHGDEERF

SEQ ID NO: 1052 - protein, 9 aa, Homo Sapiens
GPSGYGGIL

SEQ ID NO: 1053 - protein, 9 aa, Homo Sapiens
NCDQHVHCL

SEQ ID NO: 1054 - protein, 9 aa, Homo Sapiens
SVPEGTEMF

SEQ ID NO: 1055 - protein, 9 aa, Homo Sapiens
EPLGLHCTF

SEQ ID NO: 1056 - protein, 9 aa, Homo Sapiens
LAVGHVDEF

SEQ ID NO: 1057 - protein, 9 aa, Homo Sapiens
GTNVCRKPF

SEQ ID NO: 1058 - protein, 9 aa, Homo Sapiens
AFFPDLVNM

SEQ ID NO: 1059 - protein, 9 aa, Homo Sapiens
VFRVAPWIM

SEQ ID NO: 1060 - protein, 9 aa, Homo Sapiens
VPAPDGKGF

SEQ ID NO: 1061 - protein, 9 aa, Homo Sapiens
LLDDSNEDF

SEQ ID NO: 1062 - protein, 9 aa, Homo Sapiens
SPGACFKLF

SEQ ID NO: 1063 - protein, 9 aa, Homo Sapiens
GTPGVDIYI

SEQ ID NO: 1064 - protein, 9 aa, Homo Sapiens
NVCRKPFSF

SEQ ID NO: 1065 - protein, 9 aa, Homo Sapiens
CGHGRALLF

SEQ ID NO: 1066 - protein, 9 aa, Homo Sapiens
LLASPGACF

SEQ ID NO: 1067 - protein, 9 aa, Homo Sapiens
GLSFPDAGF

SEQ ID NO: 1068 - protein, 9 aa, Homo Sapiens
AGFTGLISF

SEQ ID NO: 1069 - protein, 9 aa, Homo Sapiens
GIPKPFGPI

SEQ ID NO: 1070 - protein, 9 aa, Homo Sapiens
DLNDSHVQI

SEQ ID NO: 1071 - protein, 9 aa, Homo Sapiens
AGVETLVDI

SEQ ID NO: 1072 - protein, 9 aa, Homo Sapiens
WGPSGYGGI

SEQ ID NO: 1073 - protein, 9 aa, Homo Sapiens
LAECDIIDI

SEQ ID NO: 1074 - protein, 9 aa, Homo Sapiens
QVLSNKDLI

SEQ ID NO: 1075 - protein, 9 aa, Homo Sapiens
LGLAECDII

SEQ ID NO: 1076 - protein, 9 aa, Homo Sapiens
LVLGKHLGI

SEQ ID NO: 1077 - protein, 9 aa, Homo Sapiens
KFVQSCIDW

SEQ ID NO: 1078 - protein, 9 aa, Homo Sapiens
VVFRVAPWI

SEQ ID NO: 1079 - protein, 9 aa, Homo Sapiens
YNKFVQSCI

SEQ ID NO: 1080 - protein, 9 aa, Homo Sapiens
ATLEIIVVM

SEQ ID NO: 1081 - protein, 9 aa, Homo Sapiens
IPKPFGPII

SEQ ID NO: 1082 - protein, 9 aa, Homo Sapiens
KEYPLGRIL

SEQ ID NO: 1083 - protein, 9 aa, Homo Sapiens
NFVDKRQWV

SEQ ID NO: 1084 - protein, 9 aa, Homo Sapiens
TFIDDFTPY

SEQ ID NO: 1085 - protein, 9 aa, Homo Sapiens
ELGLAECDI

SEQ ID NO: 1086 - protein, 9 aa, Homo Sapiens
LQDFPYKRI

SEQ ID NO: 1087 - protein, 9 aa, Homo Sapiens
VLYLTCVDI

SEQ ID NO: 1088 - protein, 9 aa, Homo Sapiens
GSVPEGTEM

SEQ ID NO: 1089 - protein, 9 aa, Homo Sapiens
LEEKVRSLL

SEQ ID NO: 1090 - protein, 9 aa, Homo Sapiens
KHLGIPKPF

SEQ ID NO: 1091 - protein, 9 aa, Homo Sapiens
GRILIGGNL

SEQ ID NO: 1092 - protein, 9 aa, Homo Sapiens
IYISPNMER

SEQ ID NO: 1093 - protein, 9 aa, Homo Sapiens
RRWRFDATL

SEQ ID NO: 1094 - protein, 9 aa, Homo Sapiens
NREVLKREL

SEQ ID NO: 1095 - protein, 9 aa, Homo Sapiens
KDLINYNKF

SEQ ID NO: 1096 - protein, 9 aa, Homo Sapiens
GYVTREPRD

SEQ ID NO: 1097 - protein, 9 aa, Homo Sapiens
SYEVPRLHG

SEQ ID NO: 1098 - protein, 9 aa, Homo Sapiens
MTPSTLAPL

SEQ ID NO: 1099 - protein, 9 aa, Homo Sapiens
WIMTPSTLA

SEQ ID NO: 1100 - protein, 9 aa, Homo Sapiens
LAPLEVYVC

SEQ ID NO: 1101 - protein, 9 aa, Homo Sapiens
STLAPLEVY

SEQ ID NO: 1102 - protein, 9 aa, Homo Sapiens
TLAPLEVYV

SEQ ID NO: 1103 - protein, 9 aa, Homo Sapiens
APLEVYVCR

SEQ ID NO: 1104 - protein, 9 aa, Homo Sapiens
TPSTLAPLE

SEQ ID NO: 1105 - protein, 9 aa, Homo Sapiens
IMTPSTLAP

SEQ ID NO: 1106 - protein, 9 aa, Homo Sapiens
PSTLAPLEV

SEQ ID NO: 1107 - protein, 9 aa, Homo Sapiens
VPVPDGKGF

SEQ ID NO: 1108 - protein, 9 aa, Homo Sapiens
VPDGKGFRM

SEQ ID NO: 1109 - protein, 9 aa, Homo Sapiens
SFVPVPDGK

SEQ ID NO: 1110 - protein, 9 aa, Homo Sapiens
EFLSFVPVP

SEQ ID NO: 1111 - protein, 9 aa, Homo Sapiens
FVPVPDGKG

SEQ ID NO: 1112 - protein, 9 aa, Homo Sapiens
FLSFVPVPD

SEQ ID NO: 1113 - protein, 9 aa, Homo Sapiens
DEFLSFVPV

SEQ ID NO: 1114 - protein, 9 aa, Homo Sapiens
LSFVPVPDG

SEQ ID NO: 1115 - protein, 9 aa, Homo Sapiens
PVPDGKGFR

SEQ ID NO: 1116 - protein, 10 aa, Homo Sapiens
LYLTCVDISL

SEQ ID NO: 1117 - protein, 10 aa, Homo Sapiens
GYVQAPHKTL

SEQ ID NO: 1118 - protein, 10 aa, Homo Sapiens
SYDAKRAQVF

SEQ ID NO: 1119 - protein, 10 aa, Homo Sapiens
NYNKFVQSCI

SEQ ID NO: 1120 - protein, 10 aa, Homo Sapiens
SFPDAGFTGL

SEQ ID NO: 1121 - protein, 10 aa, Homo Sapiens
AFFPDLVNML

SEQ ID NO: 1122 - protein, 10 aa, Homo Sapiens
VFDSPRNGEL

SEQ ID NO: 1123 - protein, 10 aa, Homo Sapiens
VYVCRVRNNT

SEQ ID NO: 1124 - protein, 10 aa, Homo Sapiens
PYKRILGPDF

SEQ ID NO: 1125 - protein, 10 aa, Homo Sapiens
RVTQVVRDFL

SEQ ID NO: 1126 - protein, 10 aa, Homo Sapiens
CLEEKVRSLL

SEQ ID NO: 1127 - protein, 10 aa, Homo Sapiens
LAVGHVDEFL

SEQ ID NO: 1128 - protein, 10 aa, Homo Sapiens
SLQRIVRVSL

SEQ ID NO: 1129 - protein, 10 aa, Homo Sapiens
KQKCGHGRAL

SEQ ID NO: 1130 - protein, 10 aa, Homo Sapiens
CCLEEKVRSL

SEQ ID NO: 1131 - protein, 10 aa, Homo Sapiens
EPLPLAYAVL

SEQ ID NO: 1132 - protein, 10 aa, Homo Sapiens
VNMLVLGKHL

SEQ ID NO: 1133 - protein, 10 aa, Homo Sapiens
SCIDWNREVL

SEQ ID NO: 1134 - protein, 10 aa, Homo Sapiens
DLEDMSVMVL

SEQ ID NO: 1135 - protein, 10 aa, Homo Sapiens
VVMNSPSNDL

SEQ ID NO: 1136 - protein, 10 aa, Homo Sapiens
WNREVLKREL

SEQ ID NO: 1137 - protein, 10 aa, Homo Sapiens
GLISFHVTLL

SEQ ID NO: 1138 - protein, 10 aa, Homo Sapiens
INQVLSNKDL

SEQ ID NO: 1139 - protein, 10 aa, Homo Sapiens
WGPSGYGGIL

SEQ ID NO: 1140 - protein, 10 aa, Homo Sapiens
KTERKKATAF

SEQ ID NO: 1141 - protein, 10 aa, Homo Sapiens
TGLISFHVTL

SEQ ID NO: 1142 - protein, 10 aa, Homo Sapiens
GPIINGCCCL

SEQ ID NO: 1143 - protein, 10 aa, Homo Sapiens
LPLAYAVLYL

SEQ ID NO: 1144 - protein, 10 aa, Homo Sapiens
GYGGILLVNC

SEQ ID NO: 1145 - protein, 10 aa, Homo Sapiens
LGRILIGGNL

SEQ ID NO: 1146 - protein, 10 aa, Homo Sapiens
LASPGACFKL

SEQ ID NO: 1147 - protein, 10 aa, Homo Sapiens
AYAVLYLTCV

SEQ ID NO: 1148 - protein, 10 aa, Homo Sapiens
VYGTPGVDIY

SEQ ID NO: 1149 - protein, 10 aa, Homo Sapiens
CVDISLDCDL

SEQ ID NO: 1150 - protein, 10 aa, Homo Sapiens
IMTPSTLPPL

SEQ ID NO: 1151 - protein, 10 aa, Homo Sapiens
VSGLDSFGNL

SEQ ID NO: 1152 - protein, 10 aa, Homo Sapiens
DVCEAYRHVL

SEQ ID NO: 1153 - protein, 10 aa, Homo Sapiens
DNCDQHVHCL

SEQ ID NO: 1154 - protein, 10 aa, Homo Sapiens
ALFDDHKLVL

SEQ ID NO: 1155 - protein, 10 aa, Homo Sapiens
EPRDRSVSGL

SEQ ID NO: 1156 - protein, 10 aa, Homo Sapiens
APDGKGFRML

SEQ ID NO: 1157 - protein, 10 aa, Homo Sapiens
DQHVHCLQDL

SEQ ID NO: 1158 - protein, 10 aa, Homo Sapiens
ELARKAGCKL

SEQ ID NO: 1159 - protein, 10 aa, Homo Sapiens
AQKVQPPVEL

SEQ ID NO: 1160 - protein, 10 aa, Homo Sapiens
TCFVDAVAEL

SEQ ID NO: 1161 - protein, 10 aa, Homo Sapiens
LQDFPYKRIL

SEQ ID NO: 1162 - protein, 10 aa, Homo Sapiens
FPDLVNMLVL

SEQ ID NO: 1163 - protein, 10 aa, Homo Sapiens
VLRTQGPAAL

SEQ ID NO: 1164 - protein, 10 aa, Homo Sapiens
RLHGDEERFF

SEQ ID NO: 1165 - protein, 10 aa, Homo Sapiens
APWIMTPSTL

SEQ ID NO: 1166 - protein, 10 aa, Homo Sapiens
GPSGYGGILL

SEQ ID NO: 1167 - protein, 10 aa, Homo Sapiens
KCGHGRALLF

SEQ ID NO: 1168 - protein, 10 aa, Homo Sapiens
AVCVAGVETL

SEQ ID NO: 1169 - protein, 10 aa, Homo Sapiens
ECDIIDIPQL

SEQ ID NO: 1170 - protein, 10 aa, Homo Sapiens
ISYHSSHEPL

SEQ ID NO: 1171 - protein, 10 aa, Homo Sapiens
VVANGKEYPL

SEQ ID NO: 1172 - protein, 10 aa, Homo Sapiens
ASPGACFKLF

SEQ ID NO: 1173 - protein, 10 aa, Homo Sapiens
TLLDDSNEDF

SEQ ID NO: 1174 - protein, 10 aa, Homo Sapiens
GSVPEGTEMF

SEQ ID NO: 1175 - protein, 10 aa, Homo Sapiens
SPIFTDTVVF

SEQ ID NO: 1176 - protein, 10 aa, Homo Sapiens
TNVCRKPFSF

SEQ ID NO: 1177 - protein, 10 aa, Homo Sapiens
NCEGRQDRNF

SEQ ID NO: 1178 - protein, 10 aa, Homo Sapiens
EGLSFPDAGF

SEQ ID NO: 1179 - protein, 10 aa, Homo Sapiens
FVPAPDGKGF

SEQ ID NO: 1180 - protein, 10 aa, Homo Sapiens
MLLASPGACF

SEQ ID NO: 1181 - protein, 10 aa, Homo Sapiens
SPRNGELQDF

SEQ ID NO: 1182 - protein, 10 aa, Homo Sapiens
VGHVDEFLSF

SEQ ID NO: 1183 - protein, 10 aa, Homo Sapiens
APHKTLPVVF

SEQ ID NO: 1184 - protein, 10 aa, Homo Sapiens
WLAVGHVDEF

SEQ ID NO: 1185 - protein, 10 aa, Homo Sapiens
RWRFDATLEI

SEQ ID NO: 1186 - protein, 10 aa, Homo Sapiens
LGIPKPFGPI

SEQ ID NO: 1187 - protein, 10 aa, Homo Sapiens
TVVFRVAPWI

SEQ ID NO: 1188 - protein, 10 aa, Homo Sapiens
CGTNVCRKPF

SEQ ID NO: 1189 - protein, 10 aa, Homo Sapiens
VCRVRNNTCF

SEQ ID NO: 1190 - protein, 10 aa, Homo Sapiens
DAGFTGLISF

SEQ ID NO: 1191 - protein, 10 aa, Homo Sapiens
GLHCTFIDDF

SEQ ID NO: 1192 - protein, 10 aa, Homo Sapiens
SNEDFSASPI

SEQ ID NO: 1193 - protein, 10 aa, Homo Sapiens
ELQDFPYKRI

SEQ ID NO: 1194 - protein, 10 aa, Homo Sapiens
YGTPGVDIYI

SEQ ID NO: 1195 - protein, 10 aa, Homo Sapiens
RNDRWIQDEM

SEQ ID NO: 1196 - protein, 10 aa, Homo Sapiens
QAENRNDRWI

SEQ ID NO: 1197 - protein, 10 aa, Homo Sapiens
AVLYLTCVDI

SEQ ID NO: 1198 - protein, 10 aa, Homo Sapiens
EPLGLHCTFI

SEQ ID NO: 1199 - protein, 10 aa, Homo Sapiens
KFVQSCIDWN

SEQ ID NO: 1200 - protein, 10 aa, Homo Sapiens
GIPKPFGPII

SEQ ID NO: 1201 - protein, 10 aa, Homo Sapiens
NQVLSNKDLI

SEQ ID NO: 1202 - protein, 10 aa, Homo Sapiens
MLVLGKHLGI

SEQ ID NO: 1203 - protein, 10 aa, Homo Sapiens
CFVDAVAELA

SEQ ID NO: 1204 - protein, 10 aa, Homo Sapiens
FFPDLVNMLV

SEQ ID NO: 1205 - protein, 10 aa, Homo Sapiens
GLAECDIIDI

SEQ ID NO: 1206 - protein, 10 aa, Homo Sapiens
VVDDEQVKTI

SEQ ID NO: 1207 - protein, 10 aa, Homo Sapiens
VWGPSGYGGI

SEQ ID NO: 1208 - protein, 10 aa, Homo Sapiens
RFDATLEIIV

SEQ ID NO: 1209 - protein, 10 aa, Homo Sapiens
REVLKRELGL

SEQ ID NO: 1210 - protein, 10 aa, Homo Sapiens
NGKEYPLGRI

SEQ ID NO: 1211 - protein, 10 aa, Homo Sapiens
DAKRAQVFHI

SEQ ID NO: 1212 - protein, 10 aa, Homo Sapiens
FPDAGFTGLI

SEQ ID NO: 1213 - protein, 10 aa, Homo Sapiens
VAGVETLVDI

SEQ ID NO: 1214 - protein, 10 aa, Homo Sapiens
EVYGTPGVDI

SEQ ID NO: 1215 - protein, 10 aa, Homo Sapiens
KPFSFKWWNM

SEQ ID NO: 1216 - protein, 10 aa, Homo Sapiens
IMTPSTLAPL

SEQ ID NO: 1217 - protein, 10 aa, Homo Sapiens
STLAPLEVYV

SEQ ID NO: 1218 - protein, 10 aa, Homo Sapiens
APLEVYVCRV

SEQ ID NO: 1219 - protein, 10 aa, Homo Sapiens
TLAPLEVYVC

SEQ ID NO: 1220 - protein, 10 aa, Homo Sapiens
TPSTLAPLEV

SEQ ID NO: 1221 - protein, 10 aa, Homo Sapiens
LAPLEVYVCR

SEQ ID NO: 1222 - protein, 10 aa, Homo Sapiens
MTPSTLAPLE

SEQ ID NO: 1223 - protein, 10 aa, Homo Sapiens
PWIMTPSTLA

SEQ ID NO: 1224 - protein, 10 aa, Homo Sapiens
WIMTPSTLAP

SEQ ID NO: 1225 - protein, 10 aa, Homo Sapiens
PSTLAPLEVY

SEQ ID NO: 1226 - protein, 10 aa, Homo Sapiens
VPDGKGFRML

SEQ ID NO: 1227 - protein, 10 aa, Homo Sapiens
FVPVPDGKGF

SEQ ID NO: 1228 - protein, 10 aa, Homo Sapiens
EFLSFVPVPD

SEQ ID NO: 1229 - protein, 10 aa, Homo Sapiens
SFVPVPDGKG

SEQ ID NO: 1230 - protein, 10 aa, Homo Sapiens
PVPDGKGFRM

SEQ ID NO: 1231 - protein, 10 aa, Homo Sapiens
VDEFLSFVPV

SEQ ID NO: 1232 - protein, 10 aa, Homo Sapiens
VPVPDGKGFR

SEQ ID NO: 1233 - protein, 10 aa, Homo Sapiens
LSFVPVPDGK

SEQ ID NO: 1234 - protein, 10 aa, Homo Sapiens
FLSFVPVPDG

SEQ ID NO: 1235 - protein, 10 aa, Homo Sapiens
DEFLSFVPVP

SEQ ID NO: 1236 - protein, 9 aa, Homo Sapiens
KVRSLLEPL

SEQ ID NO: 1237 - protein, 9 aa, Homo Sapiens
LARKAGCKL

SEQ ID NO: 1238 - protein, 9 aa, Homo Sapiens
GPSGYGGIL

SEQ ID NO: 1239 - protein, 9 aa, Homo Sapiens
AVGHVDEFL

SEQ ID NO: 1240 - protein, 9 aa, Homo Sapiens
LQRIVRVSL

SEQ ID NO: 1241 - protein, 9 aa, Homo Sapiens
AALFDDHKL

SEQ ID NO: 1242 - protein, 9 aa, Homo Sapiens
YVQAPHKTL

SEQ ID NO: 1243 - protein, 9 aa, Homo Sapiens
FPDAGFTGL

SEQ ID NO: 1244 - protein, 9 aa, Homo Sapiens
EVLKRELGL

SEQ ID NO: 1245 - protein, 9 aa, Homo Sapiens
KVSYEVPRL

SEQ ID NO: 1246 - protein, 9 aa, Homo Sapiens
APDGKGFRM

SEQ ID NO: 1247 - protein, 9 aa, Homo Sapiens
VANGKEYPL

SEQ ID NO: 1248 - protein, 9 aa, Homo Sapiens
KATAFFPDL

SEQ ID NO: 1249 - protein, 9 aa, Homo Sapiens
ASPGACFKL

SEQ ID NO: 1250 - protein, 9 aa, Homo Sapiens
APHKTLPVV

SEQ ID NO: 1251 - protein, 9 aa, Homo Sapiens
RVRNNTCFV

SEQ ID NO: 1252 - protein, 9 aa, Homo Sapiens
IPKPFGPII

SEQ ID NO: 1253 - protein, 9 aa, Homo Sapiens
APWIMTPST

SEQ ID NO: 1254 - protein, 9 aa, Homo Sapiens
VTQVVRDFL

SEQ ID NO: 1255 - protein, 9 aa, Homo Sapiens
DGKGFRMLL

SEQ ID NO: 1256 - protein, 9 aa, Homo Sapiens
VMNSPSNDL

SEQ ID NO: 1257 - protein, 9 aa, Homo Sapiens
KCGHGRALL

SEQ ID NO: 1258 - protein, 9 aa, Homo Sapiens
GLISFHVTL

SEQ ID NO: 1259 - protein, 9 aa, Homo Sapiens
NMLVLGKHL

SEQ ID NO: 1260 - protein, 9 aa, Homo Sapiens
EERFFVEGL

SEQ ID NO: 1261 - protein, 9 aa, Homo Sapiens
SGLDSFGNL

SEQ ID NO: 1262 - protein, 9 aa, Homo Sapiens
LISFHVTLL

SEQ ID NO: 1263 - protein, 9 aa, Homo Sapiens
VCVAGVETL

SEQ ID NO: 1264 - protein, 9 aa, Homo Sapiens
EPLPLAYAV

SEQ ID NO: 1265 - protein, 9 aa, Homo Sapiens
NQVLSNKDL

SEQ ID NO: 1266 - protein, 9 aa, Homo Sapiens
KTISINQVL

SEQ ID NO: 1267 - protein, 9 aa, Homo Sapiens
HSSHEPLPL

SEQ ID NO: 1268 - protein, 9 aa, Homo Sapiens
RSLLEPLGL

SEQ ID NO: 1269 - protein, 9 aa, Homo Sapiens
YLTCVDISL

SEQ ID NO: 1270 - protein, 9 aa, Homo Sapiens
LPGSSGRRV

SEQ ID NO: 1271 - protein, 9 aa, Homo Sapiens
SPIFTDTVV

SEQ ID NO: 1272 - protein, 9 aa, Homo Sapiens
MTPSTLPPL

SEQ ID NO: 1273 - protein, 9 aa, Homo Sapiens
EGRQDRNFV

SEQ ID NO: 1274 - protein, 9 aa, Homo Sapiens
ATLEIIVVM

SEQ ID NO: 1275 - protein, 9 aa, Homo Sapiens
SGRRVTQVV

SEQ ID NO: 1276 - protein, 9 aa, Homo Sapiens
HPTSAVCVA

SEQ ID NO: 1277 - protein, 9 aa, Homo Sapiens
EPRDRSVSG

SEQ ID NO: 1278 - protein, 9 aa, Homo Sapiens
GPIINGCCC

SEQ ID NO: 1279 - protein, 9 aa, Homo Sapiens
QVLSNKDLI

SEQ ID NO: 1280 - protein, 9 aa, Homo Sapiens
LPPLEVYVC

SEQ ID NO: 1281 - protein, 9 aa, Homo Sapiens
VPRLHGDEE

SEQ ID NO: 1282 - protein, 9 aa, Homo Sapiens
LVLGKHLGI

SEQ ID NO: 1283 - protein, 9 aa, Homo Sapiens
VVFRVAPWI

SEQ ID NO: 1284 - protein, 9 aa, Homo Sapiens
SPRNGELQD

SEQ ID NO: 1285 - protein, 9 aa, Homo Sapiens
CIDWNREVL

SEQ ID NO: 1286 - protein, 9 aa, Homo Sapiens
VCEAYRHVL

SEQ ID NO: 1287 - protein, 9 aa, Homo Sapiens
DTRRWRFDA

SEQ ID NO: 1288 - protein, 9 aa, Homo Sapiens
AVCVAGVET

SEQ ID NO: 1289 - protein, 9 aa, Homo Sapiens
AVAELARKA

SEQ ID NO: 1290 - protein, 9 aa, Homo Sapiens
AGVETLVDI

SEQ ID NO: 1291 - protein, 9 aa, Homo Sapiens
NCDQHVHCL

SEQ ID NO: 1292 - protein, 9 aa, Homo Sapiens
AKRAQVFHI

SEQ ID NO: 1293 - protein, 9 aa, Homo Sapiens
FPDLVNMLV

SEQ ID NO: 1294 - protein, 9 aa, Homo Sapiens
CLEEKVRSL

SEQ ID NO: 1295 - protein, 9 aa, Homo Sapiens
GSVPEGTEM

SEQ ID NO: 1296 - protein, 9 aa, Homo Sapiens
CVAGVETLV

SEQ ID NO: 1297 - protein, 9 aa, Homo Sapiens
VCRVRNNTC

SEQ ID NO: 1298 - protein, 9 aa, Homo Sapiens
DVCEAYRHV

SEQ ID NO: 1299 - protein, 9 aa, Homo Sapiens
NDRWIQDEM

SEQ ID NO: 1300 - protein, 9 aa, Homo Sapiens
VLRTQGPAA

SEQ ID NO: 1301 - protein, 9 aa, Homo Sapiens
VFRVAPWIM

SEQ ID NO: 1302 - protein, 9 aa, Homo Sapiens
HCLQDLEDM

SEQ ID NO: 1303 - protein, 9 aa, Homo Sapiens
YVCRVRNNT

SEQ ID NO: 1304 - protein, 9 aa, Homo Sapiens
YAVLYLTCV

SEQ ID NO: 1305 - protein, 9 aa, Homo Sapiens
ATAFFPDLV

SEQ ID NO: 1306 - protein, 9 aa, Homo Sapiens
HAQKVQPPV

SEQ ID NO: 1307 - protein, 9 aa, Homo Sapiens
QKVQPPVEL

SEQ ID NO: 1308 - protein, 9 aa, Homo Sapiens
GIPKPFGPI

SEQ ID NO: 1309 - protein, 9 aa, Homo Sapiens
RALLFQGVV

SEQ ID NO: 1310 - protein, 9 aa, Homo Sapiens
DDFTPYHML

SEQ ID NO: 1311 - protein, 9 aa, Homo Sapiens
QAPHKTLPV

SEQ ID NO: 1312 - protein, 9 aa, Homo Sapiens
ALFDDHKLV

SEQ ID NO: 1313 - protein, 9 aa, Homo Sapiens
ASPIFTDTV

SEQ ID NO: 1314 - protein, 9 aa, Homo Sapiens
DATLEIIVV

SEQ ID NO: 1315 - protein, 9 aa, Homo Sapiens
PVELFVDWL

SEQ ID NO: 1316 - protein, 9 aa, Homo Sapiens
IVRVSLEHP

SEQ ID NO: 1317 - protein, 9 aa, Homo Sapiens
VVRDFLHAQ

SEQ ID NO: 1318 - protein, 9 aa, Homo Sapiens
EVHCGTNVC

SEQ ID NO: 1319 - protein, 9 aa, Homo Sapiens
MVLRTQGPA

SEQ ID NO: 1320 - protein, 9 aa, Homo Sapiens
QVVRDFLHA

SEQ ID NO: 1321 - protein, 9 aa, Homo Sapiens
VTREPRDRS

SEQ ID NO: 1322 - protein, 9 aa, Homo Sapiens
PSGYGGILL

SEQ ID NO: 1323 - protein, 9 aa, Homo Sapiens
QDFPYKRIL

SEQ ID NO: 1324 - protein, 9 aa, Homo Sapiens
CDIIDIPQL

SEQ ID NO: 1325 - protein, 9 aa, Homo Sapiens
SPGACFKLF

SEQ ID NO: 1326 - protein, 9 aa, Homo Sapiens
FDSPRNGEL

SEQ ID NO: 1327 - protein, 9 aa, Homo Sapiens
QHVHCLQDL

SEQ ID NO: 1328 - protein, 9 aa, Homo Sapiens
EPLGLHCTF

SEQ ID NO: 1329 - protein, 9 aa, Homo Sapiens
KEYPLGRIL

SEQ ID NO: 1330 - protein, 9 aa, Homo Sapiens
RWIQDEMEL

SEQ ID NO: 1331 - protein, 9 aa, Homo Sapiens
KPFSFKWWN

SEQ ID NO: 1332 - protein, 9 aa, Homo Sapiens
QKCGHGRAL

SEQ ID NO: 1333 - protein, 9 aa, Homo Sapiens
YNKFVQSCI

SEQ ID NO: 1334 - protein, 9 aa, Homo Sapiens
PLAYAVLYL

SEQ ID NO: 1335 - protein, 9 aa, Homo Sapiens
GTPGVDIYI

SEQ ID NO: 1336 - protein, 9 aa, Homo Sapiens
MTPSTLAPL

SEQ ID NO: 1337 - protein, 9 aa, Homo Sapiens
APLEVYVCR

SEQ ID NO: 1338 - protein, 9 aa, Homo Sapiens
WIMTPSTLA

SEQ ID NO: 1339 - protein, 9 aa, Homo Sapiens
LAPLEVYVC

SEQ ID NO: 1340 - protein, 9 aa, Homo Sapiens
TPSTLAPLE

SEQ ID NO: 1341 - protein, 9 aa, Homo Sapiens
TLAPLEVYV

SEQ ID NO: 1342 - protein, 9 aa, Homo Sapiens
STLAPLEVY

SEQ ID NO: 1343 - protein, 9 aa, Homo Sapiens
PSTLAPLEV

SEQ ID NO: 1344 - protein, 9 aa, Homo Sapiens
IMTPSTLAP

SEQ ID NO: 1345 - protein, 9 aa, Homo Sapiens
VPDGKGFRM

SEQ ID NO: 1346 - protein, 9 aa, Homo Sapiens
VPVPDGKGF

SEQ ID NO: 1347 - protein, 9 aa, Homo Sapiens
FVPVPDGKG

SEQ ID NO: 1348 - protein, 9 aa, Homo Sapiens
DEFLSFVPV

SEQ ID NO: 1349 - protein, 9 aa, Homo Sapiens
LSFVPVPDG

SEQ ID NO: 1350 - protein, 9 aa, Homo Sapiens
FLSFVPVPD

SEQ ID NO: 1351 - protein, 9 aa, Homo Sapiens
PVPDGKGFR

SEQ ID NO: 1352 - protein, 9 aa, Homo Sapiens
EFLSFVPVP

SEQ ID NO: 1353 - protein, 9 aa, Homo Sapiens
SFVPVPDGK

SEQ ID NO: 1354 - protein, 10 aa, Homo Sapiens
EPRDRSVSGL

SEQ ID NO: 1355 - protein, 10 aa, Homo Sapiens
APWIMTPSTL

SEQ ID NO: 1356 - protein, 10 aa, Homo Sapiens
VVMNSPSNDL

SEQ ID NO: 1357 - protein, 10 aa, Homo Sapiens
GPSGYGGILL

SEQ ID NO: 1358 - protein, 10 aa, Homo Sapiens
GPIINGCCCL

SEQ ID NO: 1359 - protein, 10 aa, Homo Sapiens
EPLPLAYAVL

SEQ ID NO: 1360 - protein, 10 aa, Homo Sapiens
LPLAYAVLYL

SEQ ID NO: 1361 - protein, 10 aa, Homo Sapiens
APDGKGFRML

SEQ ID NO: 1362 - protein, 10 aa, Homo Sapiens
AVCVAGVETL

SEQ ID NO: 1363 - protein, 10 aa, Homo Sapiens
LGRILIGGNL

SEQ ID NO: 1364 - protein, 10 aa, Homo Sapiens
VLRTQGPAAL

SEQ ID NO: 1365 - protein, 10 aa, Homo Sapiens
WNREVLKREL

SEQ ID NO: 1366 - protein, 10 aa, Homo Sapiens
RVTQVVRDFL

SEQ ID NO: 1367 - protein, 10 aa, Homo Sapiens
DVCEAYRHVL

SEQ ID NO: 1368 - protein, 10 aa, Homo Sapiens
FPDLVNMLVL

SEQ ID NO: 1369 - protein, 10 aa, Homo Sapiens
VVANGKEYPL

SEQ ID NO: 1370 - protein, 10 aa, Homo Sapiens
KPFSFKWWNM

SEQ ID NO: 1371 - protein, 10 aa, Homo Sapiens
AQKVQPPVEL

SEQ ID NO: 1372 - protein, 10 aa, Homo Sapiens
VNMLVLGKHL

SEQ ID NO: 1373 - protein, 10 aa, Homo Sapiens
LAVGHVDEFL

SEQ ID NO: 1374 - protein, 10 aa, Homo Sapiens
ALFDDHKLVL

SEQ ID NO: 1375 - protein, 10 aa, Homo Sapiens
LASPGACFKL

SEQ ID NO: 1376 - protein, 10 aa, Homo Sapiens
EPLGLHCTFI

SEQ ID NO: 1377 - protein, 10 aa, Homo Sapiens
PPVELFVDWL

SEQ ID NO: 1378 - protein, 10 aa, Homo Sapiens
SCIDWNREVL

SEQ ID NO: 1379 - protein, 10 aa, Homo Sapiens
CVDISLDCDL

SEQ ID NO: 1380 - protein, 10 aa, Homo Sapiens
TPSTLPPLEV

SEQ ID NO: 1381 - protein, 10 aa, Homo Sapiens
SLQRIVRVSL

SEQ ID NO: 1382 - protein, 10 aa, Homo Sapiens
AVLYLTCVDI

SEQ ID NO: 1383 - protein, 10 aa, Homo Sapiens
VVFRVAPWIM

SEQ ID NO: 1384 - protein, 10 aa, Homo Sapiens
IVRVSLEHPT

SEQ ID NO: 1385 - protein, 10 aa, Homo Sapiens
VSGLDSFGNL

SEQ ID NO: 1386 - protein, 10 aa, Homo Sapiens
CCLEEKVRSL

SEQ ID NO: 1387 - protein, 10 aa, Homo Sapiens
KQKCGHGRAL

SEQ ID NO: 1388 - protein, 10 aa, Homo Sapiens
WGPSGYGGIL

SEQ ID NO: 1389 - protein, 10 aa, Homo Sapiens
TPYHMLHGEV

SEQ ID NO: 1390 - protein, 10 aa, Homo Sapiens
ELARKAGCKL

SEQ ID NO: 1391 - protein, 10 aa, Homo Sapiens
TCFVDAVAEL

SEQ ID NO: 1392 - protein, 10 aa, Homo Sapiens
GLISFHVTLL

SEQ ID NO: 1393 - protein, 10 aa, Homo Sapiens
IMTPSTLPPL

SEQ ID NO: 1394 - protein, 10 aa, Homo Sapiens
SPRNGELQDF

SEQ ID NO: 1395 - protein, 10 aa, Homo Sapiens
TRRWRFDATL

SEQ ID NO: 1396 - protein, 10 aa, Homo Sapiens
INQVLSNKDL

SEQ ID NO: 1397 - protein, 10 aa, Homo Sapiens
DNCDQHVHCL

SEQ ID NO: 1398 - protein, 10 aa, Homo Sapiens
DQHVHCLQDL

SEQ ID NO: 1399 - protein, 10 aa, Homo Sapiens
ISYHSSHEPL

SEQ ID NO: 1400 - protein, 10 aa, Homo Sapiens
TGLISFHVTL

SEQ ID NO: 1401 - protein, 10 aa, Homo Sapiens
DATLEIIVVM

SEQ ID NO: 1402 - protein, 10 aa, Homo Sapiens
LPGSSGRRVT

SEQ ID NO: 1403 - protein, 10 aa, Homo Sapiens
LARKAGCKLT

SEQ ID NO: 1404 - protein, 10 aa, Homo Sapiens
EVYGTPGVDI

SEQ ID NO: 1405 - protein, 10 aa, Homo Sapiens
TAFFPDLVNM

SEQ ID NO: 1406 - protein, 10 aa, Homo Sapiens
FPDAGFTGLI

SEQ ID NO: 1407 - protein, 10 aa, Homo Sapiens
DPSCDVQDNC

SEQ ID NO: 1408 - protein, 10 aa, Homo Sapiens
HGRALLFQGV

SEQ ID NO: 1409 - protein, 10 aa, Homo Sapiens
TVVFRVAPWI

SEQ ID NO: 1410 - protein, 10 aa, Homo Sapiens
VTREPRDRSV

SEQ ID NO: 1411 - protein, 10 aa, Homo Sapiens
KPFGPIINGC

SEQ ID NO: 1412 - protein, 10 aa, Homo Sapiens
VPRLHGDEER

SEQ ID NO: 1413 - protein, 10 aa, Homo Sapiens
AALFDDHKLV

SEQ ID NO: 1414 - protein, 10 aa, Homo Sapiens
CLEEKVRSLL

SEQ ID NO: 1415 - protein, 10 aa, Homo Sapiens
GVDIYISPNM

SEQ ID NO: 1416 - protein, 10 aa, Homo Sapiens
ECDIIDIPQL

SEQ ID NO: 1417 - protein, 10 aa, Homo Sapiens
PAALFDDHKL

SEQ ID NO: 1418 - protein, 10 aa, Homo Sapiens
DLEDMSVMVL

SEQ ID NO: 1419 - protein, 10 aa, Homo Sapiens
LQDFPYKRIL

SEQ ID NO: 1420 - protein, 10 aa, Homo Sapiens
VPEGTEMFEV

SEQ ID NO: 1421 - protein, 10 aa, Homo Sapiens
APHKTLPVVF

SEQ ID NO: 1422 - protein, 10 aa, Homo Sapiens
DAKRAQVFHI

SEQ ID NO: 1423 - protein, 10 aa, Homo Sapiens
VAGVETLVDI

SEQ ID NO: 1424 - protein, 10 aa, Homo Sapiens
AFFPDLVNML

SEQ ID NO: 1425 - protein, 10 aa, Homo Sapiens
DTRRWRFDAT

SEQ ID NO: 1426 - protein, 10 aa, Homo Sapiens
YGSVPEGTEM

SEQ ID NO: 1427 - protein, 10 aa, Homo Sapiens
KVQPPVELFV

SEQ ID NO: 1428 - protein, 10 aa, Homo Sapiens
DVQDNCDQHV

SEQ ID NO: 1429 - protein, 10 aa, Homo Sapiens
QVKTISINQV

SEQ ID NO: 1430 - protein, 10 aa, Homo Sapiens
QKCGHGRALL

SEQ ID NO: 1431 - protein, 10 aa, Homo Sapiens
KATAFFPDLV

SEQ ID NO: 1432 - protein, 10 aa, Homo Sapiens
GYVQAPHKTL

SEQ ID NO: 1433 - protein, 10 aa, Homo Sapiens
LGIPKPFGPI

SEQ ID NO: 1434 - protein, 10 aa, Homo Sapiens
NGKEYPLGRI

SEQ ID NO: 1435 - protein, 10 aa, Homo Sapiens
ASPIFTDTVV

SEQ ID NO: 1436 - protein, 10 aa, Homo Sapiens
ELQDFPYKRI

SEQ ID NO: 1437 - protein, 10 aa, Homo Sapiens
QAPHKTLPVV

SEQ ID NO: 1438 - protein, 10 aa, Homo Sapiens
SASPIFTDTV

SEQ ID NO: 1439 - protein, 10 aa, Homo Sapiens
VVDDEQVKTI

SEQ ID NO: 1440 - protein, 10 aa, Homo Sapiens
LVLHTSSYDA

SEQ ID NO: 1441 - protein, 10 aa, Homo Sapiens
EVLKRELGLA

SEQ ID NO: 1442 - protein, 10 aa, Homo Sapiens
RVSLEHPTSA

SEQ ID NO: 1443 - protein, 10 aa, Homo Sapiens
MVLRTQGPAA

SEQ ID NO: 1444 - protein, 10 aa, Homo Sapiens
VVRDFLHAQK

SEQ ID NO: 1445 - protein, 10 aa, Homo Sapiens
RVRNNTCFVD

SEQ ID NO: 1446 - protein, 10 aa, Homo Sapiens
KVRSLLEPLG

SEQ ID NO: 1447 - protein, 10 aa, Homo Sapiens
YVCRVRNNTC

SEQ ID NO: 1448 - protein, 10 aa, Homo Sapiens
GVVDDEQVKT

SEQ ID NO: 1449 - protein, 10 aa, Homo Sapiens
YGTPGVDIYI

SEQ ID NO: 1450 - protein, 10 aa, Homo Sapiens
KKATAFFPDL

SEQ ID NO: 1451 - protein, 10 aa, Homo Sapiens
IPKPFGPIIN

SEQ ID NO: 1452 - protein, 10 aa, Homo Sapiens
QPPVELFVDW

SEQ ID NO: 1453 - protein, 10 aa, Homo Sapiens
DKVSYEVPRL

SEQ ID NO: 1454 - protein, 10 aa, Homo Sapiens
APLEVYVCRV

SEQ ID NO: 1455 - protein, 10 aa, Homo Sapiens
TPSTLAPLEV

SEQ ID NO: 1456 - protein, 10 aa, Homo Sapiens
IMTPSTLAPL

SEQ ID NO: 1457 - protein, 10 aa, Homo Sapiens
STLAPLEVYV

SEQ ID NO: 1458 - protein, 10 aa, Homo Sapiens
TLAPLEVYVC

SEQ ID NO: 1459 - protein, 10 aa, Homo Sapiens
LAPLEVYVCR

SEQ ID NO: 1460 - protein, 10 aa, Homo Sapiens
WIMTPSTLAP

SEQ ID NO: 1461 - protein, 10 aa, Homo Sapiens
MTPSTLAPLE

SEQ ID NO: 1462 - protein, 10 aa, Homo Sapiens
PSTLAPLEVY

SEQ ID NO: 1463 - protein, 10 aa, Homo Sapiens
PWIMTPSTLA

SEQ ID NO: 1464 - protein, 10 aa, Homo Sapiens
VPDGKGFRML

SEQ ID NO: 1465 - protein, 10 aa, Homo Sapiens
PVPDGKGFRM

SEQ ID NO: 1466 - protein, 10 aa, Homo Sapiens
VPVPDGKGFR

SEQ ID NO: 1467 - protein, 10 aa, Homo Sapiens
FVPVPDGKGF

SEQ ID NO: 1468 - protein, 10 aa, Homo Sapiens
FLSFVPVPDG

SEQ ID NO: 1469 - protein, 10 aa, Homo Sapiens
LSFVPVPDGK

SEQ ID NO: 1470 - protein, 10 aa, Homo Sapiens
VDEFLSFVPV

SEQ ID NO: 1471 - protein, 10 aa, Homo Sapiens
SFVPVPDGKG

SEQ ID NO: 1472 - protein, 10 aa, Homo Sapiens
DEFLSFVPVP

SEQ ID NO: 1473 - protein, 10 aa, Homo Sapiens
EFLSFVPVPD

SEQ ID NO: 1474 - protein, 9 aa, Homo Sapiens
LPLAYAVLY

SEQ ID NO: 1475 - protein, 9 aa, Homo Sapiens
VPAPDGKGF

SEQ ID NO: 1476 - protein, 9 aa, Homo Sapiens
GPEDVCEAY

SEQ ID NO: 1477 - protein, 9 aa, Homo Sapiens
IPKPFGPII

SEQ ID NO: 1478 - protein, 9 aa, Homo Sapiens
SPGACFKLF

SEQ ID NO: 1479 - protein, 9 aa, Homo Sapiens
EPLGLHCTF

SEQ ID NO: 1480 - protein, 9 aa, Homo Sapiens
GPSGYGGIL

SEQ ID NO: 1481 - protein, 9 aa, Homo Sapiens
GSVPEGTEM

SEQ ID NO: 1482 - protein, 9 aa, Homo Sapiens
RSLLEPLGL

SEQ ID NO: 1483 - protein, 9 aa, Homo Sapiens
LSNKDLINY

SEQ ID NO: 1484 - protein, 9 aa, Homo Sapiens
APDGKGFRM

SEQ ID NO: 1485 - protein, 9 aa, Homo Sapiens
RSVSGLDSF

SEQ ID NO: 1486 - protein, 9 aa, Homo Sapiens
LARKAGCKL

SEQ ID NO: 1487 - protein, 9 aa, Homo Sapiens
HSSHEPLPL

SEQ ID NO: 1488 - protein, 9 aa, Homo Sapiens
KATAFFPDL

SEQ ID NO: 1489 - protein, 9 aa, Homo Sapiens
FPDAGFTGL

SEQ ID NO: 1490 - protein, 9 aa, Homo Sapiens
KVRSLLEPL

SEQ ID NO: 1491 - protein, 9 aa, Homo Sapiens
ASPGACFKL

SEQ ID NO: 1492 - protein, 9 aa, Homo Sapiens
AALFDDHKL

SEQ ID NO: 1493 - protein, 9 aa, Homo Sapiens
EPLPLAYAV

SEQ ID NO: 1494 - protein, 9 aa, Homo Sapiens
APHKTLPVV

SEQ ID NO: 1495 - protein, 9 aa, Homo Sapiens
EGTEMFEVY

SEQ ID NO: 1496 - protein, 9 aa, Homo Sapiens
LPGSSGRRV

SEQ ID NO: 1497 - protein, 9 aa, Homo Sapiens
RILGPDFGY

SEQ ID NO: 1498 - protein, 9 aa, Homo Sapiens
SPIFTDTVV

SEQ ID NO: 1499 - protein, 9 aa, Homo Sapiens
KPFSFKWWN

SEQ ID NO: 1500 - protein, 9 aa, Homo Sapiens
KLVLHTSSY

SEQ ID NO: 1501 - protein, 9 aa, Homo Sapiens
ATLEIIVVM

SEQ ID NO: 1502 - protein, 9 aa, Homo Sapiens
VANGKEYPL

SEQ ID NO: 1503 - protein, 9 aa, Homo Sapiens
DPSCDVQDN

SEQ ID NO: 1504 - protein, 9 aa, Homo Sapiens
LQRIVRVSL

SEQ ID NO: 1505 - protein, 9 aa, Homo Sapiens
HCLQDLEDM

SEQ ID NO: 1506 - protein, 9 aa, Homo Sapiens
RLHGDEERF

SEQ ID NO: 1507 - protein, 9 aa, Homo Sapiens
DGKGFRMLL

SEQ ID NO: 1508 - protein, 9 aa, Homo Sapiens
LAVGHVDEF

SEQ ID NO: 1509 - protein, 9 aa, Homo Sapiens
VLGQDKVSY

SEQ ID NO: 1510 - protein, 9 aa, Homo Sapiens
SPSNDLNDS

SEQ ID NO: 1511 - protein, 9 aa, Homo Sapiens
LPPLEVYVC

SEQ ID NO: 1512 - protein, 9 aa, Homo Sapiens
KVSYEVPRL

SEQ ID NO: 1513 - protein, 9 aa, Homo Sapiens
TPGVDIYIS

SEQ ID NO: 1514 - protein, 9 aa, Homo Sapiens
RVTQVVRDF

SEQ ID NO: 1515 - protein, 9 aa, Homo Sapiens
SGLDSFGNL

SEQ ID NO: 1516 - protein, 9 aa, Homo Sapiens
APWIMTPST

SEQ ID NO: 1517 - protein, 9 aa, Homo Sapiens
GPIINGCCC

SEQ ID NO: 1518 - protein, 9 aa, Homo Sapiens
KTISINQVL

SEQ ID NO: 1519 - protein, 9 aa, Homo Sapiens
DIIDIPQLF

SEQ ID NO: 1520 - protein, 9 aa, Homo Sapiens
KVQPPVELF

SEQ ID NO: 1521 - protein, 9 aa, Homo Sapiens
PPVELFVDW

SEQ ID NO: 1522 - protein, 9 aa, Homo Sapiens
KCGHGRALL

SEQ ID NO: 1523 - protein, 9 aa, Homo Sapiens
SVPEGTEMF

SEQ ID NO: 1524 - protein, 9 aa, Homo Sapiens
HPTSAVCVA

SEQ ID NO: 1525 - protein, 9 aa, Homo Sapiens
RTQGPAALF

SEQ ID NO: 1526 - protein, 9 aa, Homo Sapiens
YGTPGVDIY

SEQ ID NO: 1527 - protein, 9 aa, Homo Sapiens
STLPPLEVY

SEQ ID NO: 1528 - protein, 9 aa, Homo Sapiens
RADTRRWRF

SEQ ID NO: 1529 - protein, 9 aa, Homo Sapiens
DSNEDFSAS

SEQ ID NO: 1530 - protein, 9 aa, Homo Sapiens
RNFVDKRQW

SEQ ID NO: 1531 - protein, 9 aa, Homo Sapiens
RALLFQGVV

SEQ ID NO: 1532 - protein, 9 aa, Homo Sapiens
RVRNNTCFV

SEQ ID NO: 1533 - protein, 9 aa, Homo Sapiens
YNKFVQSCI

SEQ ID NO: 1534 - protein, 9 aa, Homo Sapiens
IQDEMELGY

SEQ ID NO: 1535 - protein, 9 aa, Homo Sapiens
FPDLVNMLV

SEQ ID NO: 1536 - protein, 9 aa, Homo Sapiens
EPRDRSVSG

SEQ ID NO: 1537 - protein, 9 aa, Homo Sapiens
VSLEHPTSA

SEQ ID NO: 1538 - protein, 9 aa, Homo Sapiens
YVQAPHKTL

SEQ ID NO: 1539 - protein, 9 aa, Homo Sapiens
NMLVLGKHL

SEQ ID NO: 1540 - protein, 9 aa, Homo Sapiens
VMNSPSNDL

SEQ ID NO: 1541 - protein, 9 aa, Homo Sapiens
LISFHVTLL

SEQ ID NO: 1542 - protein, 9 aa, Homo Sapiens
TSAVCVAGV

SEQ ID NO: 1543 - protein, 9 aa, Homo Sapiens
AVGHVDEFL

SEQ ID NO: 1544 - protein, 9 aa, Homo Sapiens
GLISFHVTL

SEQ ID NO: 1545 - protein, 9 aa, Homo Sapiens
CGHGRALLF

SEQ ID NO: 1546 - protein, 9 aa, Homo Sapiens
VTQVVRDFL

SEQ ID NO: 1547 - protein, 9 aa, Homo Sapiens
SSHEPLPLA

SEQ ID NO: 1548 - protein, 9 aa, Homo Sapiens
GTNVCRKPF

SEQ ID NO: 1549 - protein, 9 aa, Homo Sapiens
EVLKRELGL

SEQ ID NO: 1550 - protein, 9 aa, Homo Sapiens
GLSFPDAGF

SEQ ID NO: 1551 - protein, 9 aa, Homo Sapiens
MSLQRIVRV

SEQ ID NO: 1552 - protein, 9 aa, Homo Sapiens
ISLDCDLNC

SEQ ID NO: 1553 - protein, 9 aa, Homo Sapiens
ASPIFTDTV

SEQ ID NO: 1554 - protein, 9 aa, Homo Sapiens
VCVAGVETL

SEQ ID NO: 1555 - protein, 9 aa, Homo Sapiens
FSFKWWNMV

SEQ ID NO: 1556 - protein, 9 aa, Homo Sapiens
NQVLSNKDL

SEQ ID NO: 1557 - protein, 9 aa, Homo Sapiens
NVCRKPFSF

SEQ ID NO: 1558 - protein, 9 aa, Homo Sapiens
YLTCVDISL

SEQ ID NO: 1559 - protein, 9 aa, Homo Sapiens
MTPSTLPPL

SEQ ID NO: 1560 - protein, 9 aa, Homo Sapiens
AGFTGLISF

SEQ ID NO: 1561 - protein, 9 aa, Homo Sapiens
SSGRRVTQV

SEQ ID NO: 1562 - protein, 9 aa, Homo Sapiens
LLASPGACF

SEQ ID NO: 1563 - protein, 9 aa, Homo Sapiens
EGRQDRNFV

SEQ ID NO: 1564 - protein, 9 aa, Homo Sapiens
DATLEIIVV

SEQ ID NO: 1565 - protein, 9 aa, Homo Sapiens
DLNDSHVQI

SEQ ID NO: 1566 - protein, 9 aa, Homo Sapiens
AGVETLVDI

SEQ ID NO: 1567 - protein, 9 aa, Homo Sapiens
LSFPDAGFT

SEQ ID NO: 1568 - protein, 9 aa, Homo Sapiens
VSGLDSFGN

SEQ ID NO: 1569 - protein, 9 aa, Homo Sapiens
TSSYDAKRA

SEQ ID NO: 1570 - protein, 9 aa, Homo Sapiens
TFIDDFTPY

SEQ ID NO: 1571 - protein, 9 aa, Homo Sapiens
NDRWIQDEM

SEQ ID NO: 1572 - protein, 9 aa, Homo Sapiens
CLEEKVRSL

SEQ ID NO: 1573 - protein, 9 aa, Homo Sapiens
GVETLVDIY

SEQ ID NO: 1574 - protein, 9 aa, Homo Sapiens
STLAPLEVY

SEQ ID NO: 1575 - protein, 9 aa, Homo Sapiens
MTPSTLAPL

SEQ ID NO: 1576 - protein, 9 aa, Homo Sapiens
LAPLEVYVC

SEQ ID NO: 1577 - protein, 9 aa, Homo Sapiens
APLEVYVCR

SEQ ID NO: 1578 - protein, 9 aa, Homo Sapiens
TLAPLEVYV

SEQ ID NO: 1579 - protein, 9 aa, Homo Sapiens
TPSTLAPLE

SEQ ID NO: 1580 - protein, 9 aa, Homo Sapiens
PSTLAPLEV

SEQ ID NO: 1581 - protein, 9 aa, Homo Sapiens
WIMTPSTLA

SEQ ID NO: 1582 - protein, 9 aa, Homo Sapiens
IMTPSTLAP

SEQ ID NO: 1583 - protein, 9 aa, Homo Sapiens
VPVPDGKGF

SEQ ID NO: 1584 - protein, 9 aa, Homo Sapiens
VPDGKGFRM

SEQ ID NO: 1585 - protein, 9 aa, Homo Sapiens
LSFVPVPDG

SEQ ID NO: 1586 - protein, 9 aa, Homo Sapiens
DEFLSFVPV

SEQ ID NO: 1587 - protein, 9 aa, Homo Sapiens
FVPVPDGKG

SEQ ID NO: 1588 - protein, 9 aa, Homo Sapiens
FLSFVPVPD

SEQ ID NO: 1589 - protein, 9 aa, Homo Sapiens
PVPDGKGFR

SEQ ID NO: 1590 - protein, 9 aa, Homo Sapiens
EFLSFVPVP

SEQ ID NO: 1591 - protein, 9 aa, Homo Sapiens
SFVPVPDGK

SEQ ID NO: 1592 - protein, 10 aa, Homo Sapiens
EPRDRSVSGL

SEQ ID NO: 1593 - protein, 10 aa, Homo Sapiens
SPRNGELQDF

SEQ ID NO: 1594 - protein, 10 aa, Homo Sapiens
KPFSFKWWNM

SEQ ID NO: 1595 - protein, 10 aa, Homo Sapiens
SPIFTDTVVF

SEQ ID NO: 1596 - protein, 10 aa, Homo Sapiens
APWIMTPSTL

SEQ ID NO: 1597 - protein, 10 aa, Homo Sapiens
SSHEPLPLAY

SEQ ID NO: 1598 - protein, 10 aa, Homo Sapiens
LPLAYAVLYL

SEQ ID NO: 1599 - protein, 10 aa, Homo Sapiens
APHKTLPVVF

SEQ ID NO: 1600 - protein, 10 aa, Homo Sapiens
GPSGYGGILL

SEQ ID NO: 1601 - protein, 10 aa, Homo Sapiens
EPLPLAYAVL

SEQ ID NO: 1602 - protein, 10 aa, Homo Sapiens
GPIINGCCCL

SEQ ID NO: 1603 - protein, 10 aa, Homo Sapiens
QPPVELFVDW

SEQ ID NO: 1604 - protein, 10 aa, Homo Sapiens
TAFFPDLVNM

SEQ ID NO: 1605 - protein, 10 aa, Homo Sapiens
RNGELQDFPY

SEQ ID NO: 1606 - protein, 10 aa, Homo Sapiens
EPLGLHCTFI

SEQ ID NO: 1607 - protein, 10 aa, Homo Sapiens
WNREVLKREL

SEQ ID NO: 1608 - protein, 10 aa, Homo Sapiens
IPKPFGPIIN

SEQ ID NO: 1609 - protein, 10 aa, Homo Sapiens
APDGKGFRML

SEQ ID NO: 1610 - protein, 10 aa, Homo Sapiens
KQKCGHGRAL

SEQ ID NO: 1611 - protein, 10 aa, Homo Sapiens
FPDLVNMLVL

SEQ ID NO: 1612 - protein, 10 aa, Homo Sapiens
DATLEIIVVM

SEQ ID NO: 1613 - protein, 10 aa, Homo Sapiens
ISYHSSHEPL

SEQ ID NO: 1614 - protein, 10 aa, Homo Sapiens
GSVPEGTEMF

SEQ ID NO: 1615 - protein, 10 aa, Homo Sapiens
VSGLDSFGNL

SEQ ID NO: 1616 - protein, 10 aa, Homo Sapiens
ASPGACFKLF

SEQ ID NO: 1617 - protein, 10 aa, Homo Sapiens
PPVVANGKEY

SEQ ID NO: 1618 - protein, 10 aa, Homo Sapiens
AGVETLVDIY

SEQ ID NO: 1619 - protein, 10 aa, Homo Sapiens
RQWVWGPSGY

SEQ ID NO: 1620 - protein, 10 aa, Homo Sapiens
PPVELFVDWL

SEQ ID NO: 1621 - protein, 10 aa, Homo Sapiens
WIQDEMELGY

SEQ ID NO: 1622 - protein, 10 aa, Homo Sapiens
TPYHMLHGEV

SEQ ID NO: 1623 - protein, 10 aa, Homo Sapiens
TPSTLPPLEV

SEQ ID NO: 1624 - protein, 10 aa, Homo Sapiens
CGPEDVCEAY

SEQ ID NO: 1625 - protein, 10 aa, Homo Sapiens
KPFGPIINGC

SEQ ID NO: 1626 - protein, 10 aa, Homo Sapiens
DAKRAQVFHI

SEQ ID NO: 1627 - protein, 10 aa, Homo Sapiens
VLSNKDLINY

SEQ ID NO: 1628 - protein, 10 aa, Homo Sapiens
RLHGDEERFF

SEQ ID NO: 1629 - protein, 10 aa, Homo Sapiens
LPVVFDSPRN

SEQ ID NO: 1630 - protein, 10 aa, Homo Sapiens
LASPGACFKL

SEQ ID NO: 1631 - protein, 10 aa, Homo Sapiens
VLRTQGPAAL

SEQ ID NO: 1632 - protein, 10 aa, Homo Sapiens
DAGFTGLISF

SEQ ID NO: 1633 - protein, 10 aa, Homo Sapiens
CTFIDDFTPY

SEQ ID NO: 1634 - protein, 10 aa, Homo Sapiens
AQKVQPPVEL

SEQ ID NO: 1635 - protein, 10 aa, Homo Sapiens
VCRVRNNTCF

SEQ ID NO: 1636 - protein, 10 aa, Homo Sapiens
YGSVPEGTEM

SEQ ID NO: 1637 - protein, 10 aa, Homo Sapiens
HVLGQDKVSY

SEQ ID NO: 1638 - protein, 10 aa, Homo Sapiens
LGRILIGGNL

SEQ ID NO: 1639 - protein, 10 aa, Homo Sapiens
LAVGHVDEFL

SEQ ID NO: 1640 - protein, 10 aa, Homo Sapiens
FPDAGFTGLI

SEQ ID NO: 1641 - protein, 10 aa, Homo Sapiens
NGKEYPLGRI

SEQ ID NO: 1642 - protein, 10 aa, Homo Sapiens
SSYDAKRAQV

SEQ ID NO: 1643 - protein, 10 aa, Homo Sapiens
ALFDDHKLVL

SEQ ID NO: 1644 - protein, 10 aa, Homo Sapiens
DPSCDVQDNC

SEQ ID NO: 1645 - protein, 10 aa, Homo Sapiens
VVFRVAPWIM

SEQ ID NO: 1646 - protein, 10 aa, Homo Sapiens
SCIDWNREVL

SEQ ID NO: 1647 - protein, 10 aa, Homo Sapiens
DVCEAYRHVL

SEQ ID NO: 1648 - protein, 10 aa, Homo Sapiens
DNCDQHVHCL

SEQ ID NO: 1649 - protein, 10 aa, Homo Sapiens
LPGSSGRRVT

SEQ ID NO: 1650 - protein, 10 aa, Homo Sapiens
VSLEHPTSAV

SEQ ID NO: 1651 - protein, 10 aa, Homo Sapiens
TLLDDSNEDF

SEQ ID NO: 1652 - protein, 10 aa, Homo Sapiens
RVTQVVRDFL

SEQ ID NO: 1653 - protein, 10 aa, Homo Sapiens
KCGHGRALLF

SEQ ID NO: 1654 - protein, 10 aa, Homo Sapiens
CCLEEKVRSL

SEQ ID NO: 1655 - protein, 10 aa, Homo Sapiens
VPEGTEMFEV

SEQ ID NO: 1656 - protein, 10 aa, Homo Sapiens
FVPAPDGKGF

SEQ ID NO: 1657 - protein, 10 aa, Homo Sapiens
VCRKPFSFKW

SEQ ID NO: 1658 - protein, 10 aa, Homo Sapiens
VGHVDEFLSF

SEQ ID NO: 1659 - protein, 10 aa, Homo Sapiens
RNDRWIQDEM

SEQ ID NO: 1660 - protein, 10 aa, Homo Sapiens
VTREPRDRSV

SEQ ID NO: 1661 - protein, 10 aa, Homo Sapiens
GLAECDIIDI

SEQ ID NO: 1662 - protein, 10 aa, Homo Sapiens
FIDDFTPYHM

SEQ ID NO: 1663 - protein, 10 aa, Homo Sapiens
KATAFFPDLV

SEQ ID NO: 1664 - protein, 10 aa, Homo Sapiens
PAPDGKGFRM

SEQ ID NO: 1665 - protein, 10 aa, Homo Sapiens
VAGVETLVDI

SEQ ID NO: 1666 - protein, 10 aa, Homo Sapiens
TNVCRKPFSF

SEQ ID NO: 1667 - protein, 10 aa, Homo Sapiens
PSTLPPLEVY

SEQ ID NO: 1668 - protein, 10 aa, Homo Sapiens
INQVLSNKDL

SEQ ID NO: 1669 - protein, 10 aa, Homo Sapiens
TCFVDAVAEL

SEQ ID NO: 1670 - protein, 10 aa, Homo Sapiens
VVMNSPSNDL

SEQ ID NO: 1671 - protein, 10 aa, Homo Sapiens
TGLISFHVTL

SEQ ID NO: 1672 - protein, 10 aa, Homo Sapiens
ASPIFTDTVV

SEQ ID NO: 1673 - protein, 10 aa, Homo Sapiens
GLISFHVTLL

SEQ ID NO: 1674 - protein, 10 aa, Homo Sapiens
SLQRIVRVSL

SEQ ID NO: 1675 - protein, 10 aa, Homo Sapiens
QSCIDWNREV

SEQ ID NO: 1676 - protein, 10 aa, Homo Sapiens
IMTPSTLPPL

SEQ ID NO: 1677 - protein, 10 aa, Homo Sapiens
GSSGRRVTQV

SEQ ID NO: 1678 - protein, 10 aa, Homo Sapiens
SSGRRVTQVV

SEQ ID NO: 1679 - protein, 10 aa, Homo Sapiens
AVCVAGVETL

SEQ ID NO: 1680 - protein, 10 aa, Homo Sapiens
ELARKAGCKL

SEQ ID NO: 1681 - protein, 10 aa, Homo Sapiens
CGTNVCRKPF

SEQ ID NO: 1682 - protein, 10 aa, Homo Sapiens
GLHCTFIDDF

SEQ ID NO: 1683 - protein, 10 aa, Homo Sapiens
WGPSGYGGIL

SEQ ID NO: 1684 - protein, 10 aa, Homo Sapiens
DQHVHCLQDL

SEQ ID NO: 1685 - protein, 10 aa, Homo Sapiens
VNMLVLGKHL

SEQ ID NO: 1686 - protein, 10 aa, Homo Sapiens
EGLSFPDAGF

SEQ ID NO: 1687 - protein, 10 aa, Homo Sapiens
WLAVGHVDEF

SEQ ID NO: 1688 - protein, 10 aa, Homo Sapiens
VVANGKEYPL

SEQ ID NO: 1689 - protein, 10 aa, Homo Sapiens
MLLASPGACF

SEQ ID NO: 1690 - protein, 10 aa, Homo Sapiens
LQDLEDMSVM

SEQ ID NO: 1691 - protein, 10 aa, Homo Sapiens
AALFDDHKLV

SEQ ID NO: 1692 - protein, 10 aa, Homo Sapiens
APLEVYVCRV

SEQ ID NO: 1693 - protein, 10 aa, Homo Sapiens
TPSTLAPLEV

SEQ ID NO: 1694 - protein, 10 aa, Homo Sapiens
PSTLAPLEVY

SEQ ID NO: 1695 - protein, 10 aa, Homo Sapiens
IMTPSTLAPL

SEQ ID NO: 1696 - protein, 10 aa, Homo Sapiens
STLAPLEVYV

SEQ ID NO: 1697 - protein, 10 aa, Homo Sapiens
TLAPLEVYVC

SEQ ID NO: 1698 - protein, 10 aa, Homo Sapiens
LAPLEVYVCR

SEQ ID NO: 1699 - protein, 10 aa, Homo Sapiens
MTPSTLAPLE

SEQ ID NO: 1700 - protein, 10 aa, Homo Sapiens
WIMTPSTLAP

SEQ ID NO: 1701 - protein, 10 aa, Homo Sapiens
PWIMTPSTLA

SEQ ID NO: 1702 - protein, 10 aa, Homo Sapiens
VPDGKGFRML

SEQ ID NO: 1703 - protein, 10 aa, Homo Sapiens
FVPVPDGKGF

SEQ ID NO: 1704 - protein, 10 aa, Homo Sapiens
PVPDGKGFRM

SEQ ID NO: 1705 - protein, 10 aa, Homo Sapiens
VPVPDGKGFR

SEQ ID NO: 1706 - protein, 10 aa, Homo Sapiens
LSFVPVPDGK

SEQ ID NO: 1707 - protein, 10 aa, Homo Sapiens
FLSFVPVPDG

SEQ ID NO: 1708 - protein, 10 aa, Homo Sapiens
VDEFLSFVPV

SEQ ID NO: 1709 - protein, 10 aa, Homo Sapiens
SFVPVPDGKG

SEQ ID NO: 1710 - protein, 10 aa, Homo Sapiens
DEFLSFVPVP

SEQ ID NO: 1711 - protein, 10 aa, Homo Sapiens
EFLSFVPVPD

SEQ ID NO: 1712 - protein, 9 aa, Homo Sapiens
SHEPLPLAY

SEQ ID NO: 1713 - protein, 9 aa, Homo Sapiens
IQDEMELGY

SEQ ID NO: 1714 - protein, 9 aa, Homo Sapiens
STLPPLEVY

SEQ ID NO: 1715 - protein, 9 aa, Homo Sapiens
GPEDVCEAY

SEQ ID NO: 1716 - protein, 9 aa, Homo Sapiens
NGELQDFPY

SEQ ID NO: 1717 - protein, 9 aa, Homo Sapiens
GVETLVDIY

SEQ ID NO: 1718 - protein, 9 aa, Homo Sapiens
YGTPGVDIY

SEQ ID NO: 1719 - protein, 9 aa, Homo Sapiens
LSNKDLINY

SEQ ID NO: 1720 - protein, 9 aa, Homo Sapiens
LLEPLGLHC

SEQ ID NO: 1721 - protein, 9 aa, Homo Sapiens
NDSHVQISY

SEQ ID NO: 1722 - protein, 9 aa, Homo Sapiens
SYEVPRLHG

SEQ ID NO: 1723 - protein, 9 aa, Homo Sapiens
FTDTVVFRV

SEQ ID NO: 1724 - protein, 9 aa, Homo Sapiens
EGTEMFEVY

SEQ ID NO: 1725 - protein, 9 aa, Homo Sapiens
LPLAYAVLY

SEQ ID NO: 1726 - protein, 9 aa, Homo Sapiens
TFIDDFTPY

SEQ ID NO: 1727 - protein, 9 aa, Homo Sapiens
QWVWGPSGY

SEQ ID NO: 1728 - protein, 9 aa, Homo Sapiens
LFDDHKLVL

SEQ ID NO: 1729 - protein, 9 aa, Homo Sapiens
VLGQDKVSY

SEQ ID NO: 1730 - protein, 9 aa, Homo Sapiens
RILGPDFGY

SEQ ID NO: 1731 - protein, 9 aa, Homo Sapiens
IIDIPQLFK

SEQ ID NO: 1732 - protein, 9 aa, Homo Sapiens
GTEMFEVYG

SEQ ID NO: 1733 - protein, 9 aa, Homo Sapiens
KLVLHTSSY

SEQ ID NO: 1734 - protein, 9 aa, Homo Sapiens
FPDAGFTGL

SEQ ID NO: 1735 - protein, 9 aa, Homo Sapiens
PVVANGKEY

SEQ ID NO: 1736 - protein, 9 aa, Homo Sapiens
KTERKKATA

SEQ ID NO: 1737 - protein, 9 aa, Homo Sapiens
FPDLVNMLV

SEQ ID NO: 1738 - protein, 9 aa, Homo Sapiens
RDDPSCDVQ

SEQ ID NO: 1739 - protein, 9 aa, Homo Sapiens
FVDAVAELA

SEQ ID NO: 1740 - protein, 9 aa, Homo Sapiens
LEEKVRSLL

SEQ ID NO: 1741 - protein, 9 aa, Homo Sapiens
SLEHPTSAV

SEQ ID NO: 1742 - protein, 9 aa, Homo Sapiens
SCDVQDNCD

SEQ ID NO: 1743 - protein, 9 aa, Homo Sapiens
VCEAYRHVL

SEQ ID NO: 1744 - protein, 9 aa, Homo Sapiens
GDEERFFVE

SEQ ID NO: 1745 - protein, 9 aa, Homo Sapiens
ISFHVTLLD

SEQ ID NO: 1746 - protein, 9 aa, Homo Sapiens
TREPRDRSV

SEQ ID NO: 1747 - protein, 9 aa, Homo Sapiens
GLDSFGNLE

SEQ ID NO: 1748 - protein, 9 aa, Homo Sapiens
VDDEQVKTI

SEQ ID NO: 1749 - protein, 9 aa, Homo Sapiens
LAECDIIDI

SEQ ID NO: 1750 - protein, 9 aa, Homo Sapiens
ECDIIDIPQ

SEQ ID NO: 1751 - protein, 9 aa, Homo Sapiens
LVDIYGSVP

SEQ ID NO: 1752 - protein, 9 aa, Homo Sapiens
GTPGVDIYI

SEQ ID NO: 1753 - protein, 9 aa, Homo Sapiens
NMERGRERA

SEQ ID NO: 1754 - protein, 9 aa, Homo Sapiens
TLEIIVVMN

SEQ ID NO: 1755 - protein, 9 aa, Homo Sapiens
SLDCDLNCE

SEQ ID NO: 1756 - protein, 9 aa, Homo Sapiens
RQDRNFVDK

SEQ ID NO: 1757 - protein, 9 aa, Homo Sapiens
PSGYGGILL

SEQ ID NO: 1758 - protein, 9 aa, Homo Sapiens
SGYGGILLV

SEQ ID NO: 1759 - protein, 9 aa, Homo Sapiens
FDDHKLVLH

SEQ ID NO: 1760 - protein, 9 aa, Homo Sapiens
SYDAKRAQV

SEQ ID NO: 1761 - protein, 9 aa, Homo Sapiens
DEERFFVEG

SEQ ID NO: 1762 - protein, 9 aa, Homo Sapiens
PLEVYVCRV

SEQ ID NO: 1763 - protein, 9 aa, Homo Sapiens
KTLPVVFDS

SEQ ID NO: 1764 - protein, 9 aa, Homo Sapiens
VFDSPRNGE

SEQ ID NO: 1765 - protein, 9 aa, Homo Sapiens
VQPPVELFV

SEQ ID NO: 1766 - protein, 9 aa, Homo Sapiens
APDGKGFRM

SEQ ID NO: 1767 - protein, 9 aa, Homo Sapiens
FQEKQKCGH

SEQ ID NO: 1768 - protein, 9 aa, Homo Sapiens
VVDDEQVKT

SEQ ID NO: 1769 - protein, 9 aa, Homo Sapiens
ISINQVLSN

SEQ ID NO: 1770 - protein, 9 aa, Homo Sapiens
FTPYHMLHG

SEQ ID NO: 1771 - protein, 9 aa, Homo Sapiens
VPEGTEMFE

SEQ ID NO: 1772 - protein, 9 aa, Homo Sapiens
MFEVYGTPG

SEQ ID NO: 1773 - protein, 9 aa, Homo Sapiens
SNDLNDSHV

SEQ ID NO: 1774 - protein, 9 aa, Homo Sapiens
FVDKRQWVW

SEQ ID NO: 1775 - protein, 9 aa, Homo Sapiens
DLEDMSVMV

SEQ ID NO: 1776 - protein, 9 aa, Homo Sapiens
LEDMSVMVL

SEQ ID NO: 1777 - protein, 9 aa, Homo Sapiens
GQDKVSYEV

SEQ ID NO: 1778 - protein, 9 aa, Homo Sapiens
FVEGLSFPD

SEQ ID NO: 1779 - protein, 9 aa, Homo Sapiens
LLDDSNEDF

SEQ ID NO: 1780 - protein, 9 aa, Homo Sapiens
SNEDFSASP

SEQ ID NO: 1781 - protein, 9 aa, Homo Sapiens
VAELARKAG

SEQ ID NO: 1782 - protein, 9 aa, Homo Sapiens
EMELGYVQA

SEQ ID NO: 1783 - protein, 9 aa, Homo Sapiens
GPDFGYVTR

SEQ ID NO: 1784 - protein, 9 aa, Homo Sapiens
NLEVSPPVV

SEQ ID NO: 1785 - protein, 9 aa, Homo Sapiens
VSPPVVANG

SEQ ID NO: 1786 - protein, 9 aa, Homo Sapiens
VDEFLSFVP

SEQ ID NO: 1787 - protein, 9 aa, Homo Sapiens
DDEQVKTIS

SEQ ID NO: 1788 - protein, 9 aa, Homo Sapiens
CIDWNREVL

SEQ ID NO: 1789 - protein, 9 aa, Homo Sapiens
KRELGLAEC

SEQ ID NO: 1790 - protein, 9 aa, Homo Sapiens
CLEEKVRSL

SEQ ID NO: 1791 - protein, 9 aa, Homo Sapiens
GVDIYISPN

SEQ ID NO: 1792 - protein, 9 aa, Homo Sapiens
RADTRRWRF

SEQ ID NO: 1793 - protein, 9 aa, Homo Sapiens
LNDSHVQIS

SEQ ID NO: 1794 - protein, 9 aa, Homo Sapiens
NCEGRQDRN

SEQ ID NO: 1795 - protein, 9 aa, Homo Sapiens
DRDDPSCDV

SEQ ID NO: 1796 - protein, 9 aa, Homo Sapiens
VQDNCDQHV

SEQ ID NO: 1797 - protein, 9 aa, Homo Sapiens
NCDQHVHCL

SEQ ID NO: 1798 - protein, 9 aa, Homo Sapiens
HGDEERFFV

SEQ ID NO: 1799 - protein, 9 aa, Homo Sapiens
PSTLPPLEV

SEQ ID NO: 1800 - protein, 9 aa, Homo Sapiens
QAENRNDRW

SEQ ID NO: 1801 - protein, 9 aa, Homo Sapiens
LQDFPYKRI

SEQ ID NO: 1802 - protein, 9 aa, Homo Sapiens
PRDRSVSGL

SEQ ID NO: 1803 - protein, 9 aa, Homo Sapiens
GKEYPLGRI

SEQ ID NO: 1804 - protein, 9 aa, Homo Sapiens
ILIGGNLPG

SEQ ID NO: 1805 - protein, 9 aa, Homo Sapiens
VRDFLHAQK

SEQ ID NO: 1806 - protein, 9 aa, Homo Sapiens
PVELFVDWL

SEQ ID NO: 1807 - protein, 9 aa, Homo Sapiens
FVDWLAVGH

SEQ ID NO: 1808 - protein, 9 aa, Homo Sapiens
NKDLINYNK

SEQ ID NO: 1809 - protein, 9 aa, Homo Sapiens
FIDDFTPYH

SEQ ID NO: 1810 - protein, 9 aa, Homo Sapiens
GRERADTRR

SEQ ID NO: 1811 - protein, 9 aa, Homo Sapiens
RFDATLEII

SEQ ID NO: 1812 - protein, 9 aa, Homo Sapiens
NSPSNDLND

SEQ ID NO: 1813 - protein, 9 aa, Homo Sapiens
HSSHEPLPL

SEQ ID NO: 1814 - protein, 9 aa, Homo Sapiens
CVDISLDCD

SEQ ID NO: 1815 - protein, 9 aa, Homo Sapiens
ISLDCDLNC

SEQ ID NO: 1816 - protein, 9 aa, Homo Sapiens
DCDLNCEGR

SEQ ID NO: 1817 - protein, 9 aa, Homo Sapiens
NCDRDDPSC

SEQ ID NO: 1818 - protein, 9 aa, Homo Sapiens
LQDLEDMSV

SEQ ID NO: 1819 - protein, 9 aa, Homo Sapiens
RTQGPAALF

SEQ ID NO: 1820 - protein, 9 aa, Homo Sapiens
TQGPAALFD

SEQ ID NO: 1821 - protein, 9 aa, Homo Sapiens
PEDVCEAYR

SEQ ID NO: 1822 - protein, 9 aa, Homo Sapiens
LDDSNEDFS

SEQ ID NO: 1823 - protein, 9 aa, Homo Sapiens
NEDFSASPI

SEQ ID NO: 1824 - protein, 9 aa, Homo Sapiens
IMTPSTLPP

SEQ ID NO: 1825 - protein, 9 aa, Homo Sapiens
RNDRWIQDE

SEQ ID NO: 1826 - protein, 9 aa, Homo Sapiens
QDEMELGYV

SEQ ID NO: 1827 - protein, 9 aa, Homo Sapiens
SPRNGELQD

SEQ ID NO: 1828 - protein, 9 aa, Homo Sapiens
VTQVVRDFL

SEQ ID NO: 1829 - protein, 9 aa, Homo Sapiens
HVDEFLSFV

SEQ ID NO: 1830 - protein, 9 aa, Homo Sapiens
NREVLKREL

SEQ ID NO: 1831 - protein, 9 aa, Homo Sapiens
RSLLEPLGL

SEQ ID NO: 1832 - protein, 9 aa, Homo Sapiens
IDDFTPYHM

SEQ ID NO: 1833 - protein, 9 aa, Homo Sapiens
HGEVHCGTN

SEQ ID NO: 1834 - protein, 9 aa, Homo Sapiens
GSVPEGTEM

SEQ ID NO: 1835 - protein, 9 aa, Homo Sapiens
SSHEPLPLA

SEQ ID NO: 1836 - protein, 9 aa, Homo Sapiens
YLTCVDISL

SEQ ID NO: 1837 - protein, 9 aa, Homo Sapiens
VHCLQDLED

SEQ ID NO: 1838 - protein, 9 aa, Homo Sapiens
HTSSYDAKR

SEQ ID NO: 1839 - protein, 9 aa, Homo Sapiens
VSYEVPRLH

SEQ ID NO: 1840 - protein, 9 aa, Homo Sapiens
SASPIFTDT

SEQ ID NO: 1841 - protein, 9 aa, Homo Sapiens
NTCFVDAVA

SEQ ID NO: 1842 - protein, 9 aa, Homo Sapiens
VTREPRDRS

SEQ ID NO: 1843 - protein, 9 aa, Homo Sapiens
LDSFGNLEV

SEQ ID NO: 1844 - protein, 9 aa, Homo Sapiens
EYPLGRILI

SEQ ID NO: 1845 - protein, 9 aa, Homo Sapiens
YPLGRILIG

SEQ ID NO: 1846 - protein, 9 aa, Homo Sapiens
QVVRDFLHA

SEQ ID NO: 1847 - protein, 9 aa, Homo Sapiens
GHVDEFLSF

SEQ ID NO: 1848 - protein, 9 aa, Homo Sapiens
CGHGRALLF

SEQ ID NO: 1849 - protein, 9 aa, Homo Sapiens
DWNREVLKR

SEQ ID NO: 1850 - protein, 9 aa, Homo Sapiens
ATAFFPDLV

SEQ ID NO: 1851 - protein, 9 aa, Homo Sapiens
RIVRVSLEH

SEQ ID NO: 1852 - protein, 9 aa, Homo Sapiens
PTSAVCVAG

SEQ ID NO: 1853 - protein, 9 aa, Homo Sapiens
VAGVETLVD

SEQ ID NO: 1854 - protein, 9 aa, Homo Sapiens
ATLEIIVVM

SEQ ID NO: 1855 - protein, 9 aa, Homo Sapiens
PLAYAVLYL

SEQ ID NO: 1856 - protein, 9 aa, Homo Sapiens
LTCVDISLD

SEQ ID NO: 1857 - protein, 9 aa, Homo Sapiens
GYGGILLVN

SEQ ID NO: 1858 - protein, 9 aa, Homo Sapiens
LSFPDAGFT

SEQ ID NO: 1859 - protein, 9 aa, Homo Sapiens
SFHVTLLDD

SEQ ID NO: 1860 - protein, 9 aa, Homo Sapiens
ILGPDFGYV

SEQ ID NO: 1861 - protein, 9 aa, Homo Sapiens
KVQPPVELF

SEQ ID NO: 1862 - protein, 9 aa, Homo Sapiens
GKGFRMLLA

SEQ ID NO: 1863 - protein, 9 aa, Homo Sapiens
ASPGACFKL

SEQ ID NO: 1864 - protein, 9 aa, Homo Sapiens
KTISINQVL

SEQ ID NO: 1865 - protein, 9 aa, Homo Sapiens
VLSNKDLIN

SEQ ID NO: 1866 - protein, 9 aa, Homo Sapiens
IDIPQLFKT

SEQ ID NO: 1867 - protein, 9 aa, Homo Sapiens
TAFFPDLVN

SEQ ID NO: 1868 - protein, 9 aa, Homo Sapiens
EEKVRSLLE

SEQ ID NO: 1869 - protein, 9 aa, Homo Sapiens
GLHCTFIDD

SEQ ID NO: 1870 - protein, 9 aa, Homo Sapiens
VETLVDIYG

SEQ ID NO: 1871 - protein, 9 aa, Homo Sapiens
DTRRWRFDA

SEQ ID NO: 1872 - protein, 9 aa, Homo Sapiens
MNSPSNDLN

SEQ ID NO: 1873 - protein, 9 aa, Homo Sapiens
AYAVLYLTC

SEQ ID NO: 1874 - protein, 9 aa, Homo Sapiens
DMSVMVLRT

SEQ ID NO: 1875 - protein, 9 aa, Homo Sapiens
DDHKLVLHT

SEQ ID NO: 1876 - protein, 9 aa, Homo Sapiens
EAYRHVLGQ

SEQ ID NO: 1877 - protein, 9 aa, Homo Sapiens
RFFVEGLSF

SEQ ID NO: 1878 - protein, 9 aa, Homo Sapiens
DAGFTGLIS

SEQ ID NO: 1879 - protein, 9 aa, Homo Sapiens
AGFTGLISF

SEQ ID NO: 1880 - protein, 9 aa, Homo Sapiens
FTGLISFHV

SEQ ID NO: 1881 - protein, 9 aa, Homo Sapiens
VTLLDDSNE

SEQ ID NO: 1882 - protein, 9 aa, Homo Sapiens
DSNEDFSAS

SEQ ID NO: 1883 - protein, 9 aa, Homo Sapiens
DTVVFRVAP

SEQ ID NO: 1884 - protein, 9 aa, Homo Sapiens
FRVAPWIMT

SEQ ID NO: 1885 - protein, 9 aa, Homo Sapiens
VDAVAELAR

SEQ ID NO: 1886 - protein, 9 aa, Homo Sapiens
RKAGCKLTI

SEQ ID NO: 1887 - protein, 9 aa, Homo Sapiens
LTICPQAEN

SEQ ID NO: 1888 - protein, 9 aa, Homo Sapiens
VQAPHKTLP

SEQ ID NO: 1889 - protein, 9 aa, Homo Sapiens
DSPRNGELQ

SEQ ID NO: 1890 - protein, 9 aa, Homo Sapiens
DFPYKRILG

SEQ ID NO: 1891 - protein, 9 aa, Homo Sapiens
FPYKRILGP

SEQ ID NO: 1892 - protein, 9 aa, Homo Sapiens
DRSVSGLDS

SEQ ID NO: 1893 - protein, 9 aa, Homo Sapiens
NGKEYPLGR

SEQ ID NO: 1894 - protein, 9 aa, Homo Sapiens
SSGRRVTQV

SEQ ID NO: 1895 - protein, 9 aa, Homo Sapiens
ELFVDWLAV

SEQ ID NO: 1896 - protein, 9 aa, Homo Sapiens
SPGACFKLF

SEQ ID NO: 1897 - protein, 9 aa, Homo Sapiens
LKRELGLAE

SEQ ID NO: 1898 - protein, 9 aa, Homo Sapiens
PDLVNMLVL

SEQ ID NO: 1899 - protein, 9 aa, Homo Sapiens
LVNMLVLGK

SEQ ID NO: 1900 - protein, 9 aa, Homo Sapiens
LVLGKHLGI

SEQ ID NO: 1901 - protein, 9 aa, Homo Sapiens
DFTPYHMLH

SEQ ID NO: 1902 - protein, 9 aa, Homo Sapiens
GTNVCRKPF

SEQ ID NO: 1903 - protein, 9 aa, Homo Sapiens
ETLVDIYGS

SEQ ID NO: 1904 - protein, 9 aa, Homo Sapiens
YISPNMERG

SEQ ID NO: 1905 - protein, 9 aa, Homo Sapiens
WRFDATLEI

SEQ ID NO: 1906 - protein, 9 aa, Homo Sapiens
DSHVQISYH

SEQ ID NO: 1907 - protein, 9 aa, Homo Sapiens
TCVDISLDC

SEQ ID NO: 1908 - protein, 9 aa, Homo Sapiens
VWGPSGYGG

SEQ ID NO: 1909 - protein, 9 aa, Homo Sapiens
PSCDVQDNC

SEQ ID NO: 1910 - protein, 9 aa, Homo Sapiens
DQHVHCLQD

SEQ ID NO: 1911 - protein, 9 aa, Homo Sapiens
MSVMVLRTQ

SEQ ID NO: 1912 - protein, 9 aa, Homo Sapiens
SSYDAKRAQ

SEQ ID NO: 1913 - protein, 9 aa, Homo Sapiens
YEVPRLHGD

SEQ ID NO: 1914 - protein, 9 aa, Homo Sapiens
FSASPIFTD

SEQ ID NO: 1915 - protein, 9 aa, Homo Sapiens
TDTVVFRVA

SEQ ID NO: 1916 - protein, 9 aa, Homo Sapiens
MTPSTLPPL

SEQ ID NO: 1917 - protein, 9 aa, Homo Sapiens
TICPQAENR

SEQ ID NO: 1918 - protein, 9 aa, Homo Sapiens
QAPHKTLPV

SEQ ID NO: 1919 - protein, 9 aa, Homo Sapiens
TLPVVFDSP

SEQ ID NO: 1920 - protein, 9 aa, Homo Sapiens
FDSPRNGEL

SEQ ID NO: 1921 - protein, 9 aa, Homo Sapiens
RSVSGLDSF

SEQ ID NO: 1922 - protein, 9 aa, Homo Sapiens
DSFGNLEVS

SEQ ID NO: 1923 - protein, 9 aa, Homo Sapiens
EVSPPVVAN

SEQ ID NO: 1924 - protein, 9 aa, Homo Sapiens
GNLPGSSGR

SEQ ID NO: 1925 - protein, 9 aa, Homo Sapiens
GSSGRRVTQ

SEQ ID NO: 1926 - protein, 9 aa, Homo Sapiens
SFVPAPDGK

SEQ ID NO: 1927 - protein, 9 aa, Homo Sapiens
VPAPDGKGF

SEQ ID NO: 1928 - protein, 9 aa, Homo Sapiens
PDGKGFRML

SEQ ID NO: 1929 - protein, 9 aa, Homo Sapiens
KGFRMLLAS

SEQ ID NO: 1930 - protein, 9 aa, Homo Sapiens
LASPGACFK

SEQ ID NO: 1931 - protein, 9 aa, Homo Sapiens
PGACFKLFQ

SEQ ID NO: 1932 - protein, 9 aa, Homo Sapiens
GHGRALLFQ

SEQ ID NO: 1933 - protein, 9 aa, Homo Sapiens
ALLFQGVVD

SEQ ID NO: 1934 - protein, 9 aa, Homo Sapiens
EVLKRELGL

SEQ ID NO: 1935 - protein, 9 aa, Homo Sapiens
PKPFGPIIN

SEQ ID NO: 1936 - protein, 9 aa, Homo Sapiens
KPFGPIING

SEQ ID NO: 1937 - protein, 9 aa, Homo Sapiens
INGCCCLEE

SEQ ID NO: 1938 - protein, 9 aa, Homo Sapiens
EKVRSLLEP

SEQ ID NO: 1939 - protein, 9 aa, Homo Sapiens
SLLEPLGLH

SEQ ID NO: 1940 - protein, 9 aa, Homo Sapiens
CTFIDDFTP

SEQ ID NO: 1941 - protein, 9 aa, Homo Sapiens
CRKPFSFKW

SEQ ID NO: 1942 - protein, 9 aa, Homo Sapiens
FSFKWWNMV

SEQ ID NO: 1943 - protein, 9 aa, Homo Sapiens
SLQRIVRVS

SEQ ID NO: 1944 - protein, 9 aa, Homo Sapiens
VSLEHPTSA

SEQ ID NO: 1945 - protein, 9 aa, Homo Sapiens
LEHPTSAVC

SEQ ID NO: 1946 - protein, 9 aa, Homo Sapiens
TSAVCVAGV

SEQ ID NO: 1947 - protein, 9 aa, Homo Sapiens
SAVCVAGVE

SEQ ID NO: 1948 - protein, 9 aa, Homo Sapiens
CVAGVETLV

SEQ ID NO: 1949 - protein, 9 aa, Homo Sapiens
SVPEGTEMF

SEQ ID NO: 1950 - protein, 9 aa, Homo Sapiens
FDATLEIIV

SEQ ID NO: 1951 - protein, 9 aa, Homo Sapiens
DATLEIIVV

SEQ ID NO: 1952 - protein, 9 aa, Homo Sapiens
PSNDLNDSH

SEQ ID NO: 1953 - protein, 9 aa, Homo Sapiens
VLRTQGPAA

SEQ ID NO: 1954 - protein, 9 aa, Homo Sapiens
KRAQVFHIC

SEQ ID NO: 1955 - protein, 9 aa, Homo Sapiens
ASPIFTDTV

SEQ ID NO: 1956 - protein, 9 aa, Homo Sapiens
TLPPLEVYV

SEQ ID NO: 1957 - protein, 9 aa, Homo Sapiens
YVCRVRNNT

SEQ ID NO: 1958 - protein, 9 aa, Homo Sapiens
ARKAGCKLT

SEQ ID NO: 1959 - protein, 9 aa, Homo Sapiens
AGCKLTICP

SEQ ID NO: 1960 - protein, 9 aa, Homo Sapiens
QDFPYKRIL

SEQ ID NO: 1961 - protein, 9 aa, Homo Sapiens
VSGLDSFGN

SEQ ID NO: 1962 - protein, 9 aa, Homo Sapiens
SGLDSFGNL

SEQ ID NO: 1963 - protein, 9 aa, Homo Sapiens
KEYPLGRIL

SEQ ID NO: 1964 - protein, 9 aa, Homo Sapiens
PLGRILIGG

SEQ ID NO: 1965 - protein, 9 aa, Homo Sapiens
RILIGGNLP

SEQ ID NO: 1966 - protein, 9 aa, Homo Sapiens
SGRRVTQVV

SEQ ID NO: 1967 - protein, 9 aa, Homo Sapiens
VELFVDWLA

SEQ ID NO: 1968 - protein, 9 aa, Homo Sapiens
LSFVPAPDG

SEQ ID NO: 1969 - protein, 9 aa, Homo Sapiens
KCGHGRALL

SEQ ID NO: 1970 - protein, 9 aa, Homo Sapiens
GLAECDIID

SEQ ID NO: 1971 - protein, 9 aa, Homo Sapiens
AFFPDLVNM

SEQ ID NO: 1972 - protein, 9 aa, Homo Sapiens
VNMLVLGKH

SEQ ID NO: 1973 - protein, 9 aa, Homo Sapiens
MLVLGKHLG

SEQ ID NO: 1974 - protein, 9 aa, Homo Sapiens
LGKHLGIPK

SEQ ID NO: 1975 - protein, 9 aa, Homo Sapiens
IPKPFGPII

SEQ ID NO: 1976 - protein, 9 aa, Homo Sapiens
VCRKPFSFK

SEQ ID NO: 1977 - protein, 9 aa, Homo Sapiens
MSLQRIVRV

SEQ ID NO: 1978 - protein, 9 aa, Homo Sapiens
VCVAGVETL

SEQ ID NO: 1979 - protein, 9 aa, Homo Sapiens
PGVDIYISP

SEQ ID NO: 1980 - protein, 9 aa, Homo Sapiens
ISPNMERGR

SEQ ID NO: 1981 - protein, 9 aa, Homo Sapiens
ISYHSSHEP

SEQ ID NO: 1982 - protein, 9 aa, Homo Sapiens
YHSSHEPLP

SEQ ID NO: 1983 - protein, 9 aa, Homo Sapiens
EPLPLAYAV

SEQ ID NO: 1984 - protein, 9 aa, Homo Sapiens
LAYAVLYLT

SEQ ID NO: 1985 - protein, 9 aa, Homo Sapiens
CDQHVHCLQ

SEQ ID NO: 1986 - protein, 9 aa, Homo Sapiens
EDMSVMVLR

SEQ ID NO: 1987 - protein, 9 aa, Homo Sapiens
ALFDDHKLV

SEQ ID NO: 1988 - protein, 9 aa, Homo Sapiens
TSSYDAKRA

SEQ ID NO: 1989 - protein, 9 aa, Homo Sapiens
AKRAQVFHI

SEQ ID NO: 1990 - protein, 9 aa, Homo Sapiens
RAQVFHICG

SEQ ID NO: 1991 - protein, 9 aa, Homo Sapiens
ICGPEDVCE

SEQ ID NO: 1992 - protein, 9 aa, Homo Sapiens
RHVLGQDKV

SEQ ID NO: 1993 - protein, 9 aa, Homo Sapiens
HVLGQDKVS

SEQ ID NO: 1994 - protein, 9 aa, Homo Sapiens
ERFFVEGLS

SEQ ID NO: 1995 - protein, 9 aa, Homo Sapiens
VEGLSFPDA

SEQ ID NO: 1996 - protein, 9 aa, Homo Sapiens
TGLISFHVT

SEQ ID NO: 1997 - protein, 9 aa, Homo Sapiens
DFSASPIFT

SEQ ID NO: 1998 - protein, 9 aa, Homo Sapiens
RVAPWIMTP

SEQ ID NO: 1999 - protein, 9 aa, Homo Sapiens
NRNDRWIQD

SEQ ID NO: 2000 - protein, 9 aa, Homo Sapiens
RDRSVSGLD

SEQ ID NO: 2001 - protein, 9 aa, Homo Sapiens
SPPVVANGK

SEQ ID NO: 2002 - protein, 9 aa, Homo Sapiens
PGSSGRRVT

SEQ ID NO: 2003 - protein, 9 aa, Homo Sapiens
FLHAQKVQP

SEQ ID NO: 2004 - protein, 9 aa, Homo Sapiens
AQKVQPPVE

SEQ ID NO: 2005 - protein, 9 aa, Homo Sapiens
DWLAVGHVD

SEQ ID NO: 2006 - protein, 9 aa, Homo Sapiens
FLSFVPAPD

SEQ ID NO: 2007 - protein, 9 aa, Homo Sapiens
FVPAPDGKG

SEQ ID NO: 2008 - protein, 9 aa, Homo Sapiens
DGKGFRMLL

SEQ ID NO: 2009 - protein, 9 aa, Homo Sapiens
ACFKLFQEK

SEQ ID NO: 2010 - protein, 9 aa, Homo Sapiens
LLFQGVVDD

SEQ ID NO: 2011 - protein, 9 aa, Homo Sapiens
LFQGVVDDE

SEQ ID NO: 2012 - protein, 9 aa, Homo Sapiens
DEQVKTISI

SEQ ID NO: 2013 - protein, 9 aa, Homo Sapiens
QVKTISINQ

SEQ ID NO: 2014 - protein, 9 aa, Homo Sapiens
SINQVLSNK

SEQ ID NO: 2015 - protein, 9 aa, Homo Sapiens
YNKFVQSCI

SEQ ID NO: 2016 - protein, 9 aa, Homo Sapiens
KFVQSCIDW

SEQ ID NO: 2017 - protein, 9 aa, Homo Sapiens
QSCIDWNRE

SEQ ID NO: 2018 - protein, 9 aa, Homo Sapiens
VLKRELGLA

SEQ ID NO: 2019 - protein, 9 aa, Homo Sapiens
GKHLGIPKP

SEQ ID NO: 2020 - protein, 9 aa, Homo Sapiens
LGIPKPFGP

SEQ ID NO: 2021 - protein, 9 aa, Homo Sapiens
GIPKPFGPI

SEQ ID NO: 2022 - protein, 9 aa, Homo Sapiens
PFGPIINGC

SEQ ID NO: 2023 - protein, 9 aa, Homo Sapiens
YHMLHGEVH

SEQ ID NO: 2024 - protein, 9 aa, Homo Sapiens
CGTNVCRKP

SEQ ID NO: 2025 - protein, 9 aa, Homo Sapiens
SFKWWNMVP

SEQ ID NO: 2026 - protein, 9 aa, Homo Sapiens
LQRIVRVSL

SEQ ID NO: 2027 - protein, 9 aa, Homo Sapiens
QRIVRVSLE

SEQ ID NO: 2028 - protein, 9 aa, Homo Sapiens
VDIYGSVPE

SEQ ID NO: 2029 - protein, 9 aa, Homo Sapiens
YGSVPEGTE

SEQ ID NO: 2030 - protein, 9 aa, Homo Sapiens
FEVYGTPGV

SEQ ID NO: 2031 - protein, 9 aa, Homo Sapiens
VYGTPGVDI

SEQ ID NO: 2032 - protein, 9 aa, Homo Sapiens
SPNMERGRE

SEQ ID NO: 2033 - protein, 9 aa, Homo Sapiens
TRRWRFDAT

SEQ ID NO: 2034 - protein, 9 aa, Homo Sapiens
LEIIVVMNS

SEQ ID NO: 2035 - protein, 9 aa, Homo Sapiens
YAVLYLTCV

SEQ ID NO: 2036 - protein, 9 aa, Homo Sapiens
LNCEGRQDR

SEQ ID NO: 2037 - protein, 9 aa, Homo Sapiens
QDRNFVDKR

SEQ ID NO: 2038 - protein, 9 aa, Homo Sapiens
VDKRQWVWG

SEQ ID NO: 2039 - protein, 9 aa, Homo Sapiens
GPSGYGGIL

SEQ ID NO: 2040 - protein, 9 aa, Homo Sapiens
GILLVNCDR

SEQ ID NO: 2041 - protein, 9 aa, Homo Sapiens
SVMVLRTQG

SEQ ID NO: 2042 - protein, 9 aa, Homo Sapiens
GPAALFDDH

SEQ ID NO: 2043 - protein, 9 aa, Homo Sapiens
AALFDDHKL

SEQ ID NO: 2044 - protein, 9 aa, Homo Sapiens
YDAKRAQVF

SEQ ID NO: 2045 - protein, 9 aa, Homo Sapiens
FHICGPEDV

SEQ ID NO: 2046 - protein, 9 aa, Homo Sapiens
HICGPEDVC

SEQ ID NO: 2047 - protein, 9 aa, Homo Sapiens
AYRHVLGQD

SEQ ID NO: 2048 - protein, 9 aa, Homo Sapiens
YRHVLGQDK

SEQ ID NO: 2049 - protein, 9 aa, Homo Sapiens
FFVEGLSFP

SEQ ID NO: 2050 - protein, 9 aa, Homo Sapiens
SFPDAGFTG

SEQ ID NO: 2051 - protein, 9 aa, Homo Sapiens
PDAGFTGLI

SEQ ID NO: 2052 - protein, 9 aa, Homo Sapiens
LISFHVTLL

SEQ ID NO: 2053 - protein, 9 aa, Homo Sapiens
SPIFTDTVV

SEQ ID NO: 2054 - protein, 9 aa, Homo Sapiens
VVFRVAPWI

SEQ ID NO: 2055 - protein, 9 aa, Homo Sapiens
WIMTPSTLP

SEQ ID NO: 2056 - protein, 9 aa, Homo Sapiens
LEVYVCRVR

SEQ ID NO: 2057 - protein, 9 aa, Homo Sapiens
RNNTCFVDA

SEQ ID NO: 2058 - protein, 9 aa, Homo Sapiens
AVAELARKA

SEQ ID NO: 2059 - protein, 9 aa, Homo Sapiens
LARKAGCKL

SEQ ID NO: 2060 - protein, 9 aa, Homo Sapiens
DRWIQDEME

SEQ ID NO: 2061 - protein, 9 aa, Homo Sapiens
MELGYVQAP

SEQ ID NO: 2062 - protein, 9 aa, Homo Sapiens
ELGYVQAPH

SEQ ID NO: 2063 - protein, 9 aa, Homo Sapiens
YVQAPHKTL

SEQ ID NO: 2064 - protein, 9 aa, Homo Sapiens
GELQDFPYK

SEQ ID NO: 2065 - protein, 9 aa, Homo Sapiens
ELQDFPYKR

SEQ ID NO: 2066 - protein, 9 aa, Homo Sapiens
YKRILGPDF

SEQ ID NO: 2067 - protein, 9 aa, Homo Sapiens
PDFGYVTRE

SEQ ID NO: 2068 - protein, 9 aa, Homo Sapiens
SVSGLDSFG

SEQ ID NO: 2069 - protein, 9 aa, Homo Sapiens
PPVVANGKE

SEQ ID NO: 2070 - protein, 9 aa, Homo Sapiens
VVANGKEYP

SEQ ID NO: 2071 - protein, 9 aa, Homo Sapiens
ANGKEYPLG

SEQ ID NO: 2072 - protein, 9 aa, Homo Sapiens
RRVTQVVRD

SEQ ID NO: 2073 - protein, 9 aa, Homo Sapiens
RVTQVVRDF

SEQ ID NO: 2074 - protein, 9 aa, Homo Sapiens
PPVELFVDW

SEQ ID NO: 2075 - protein, 9 aa, Homo Sapiens
WLAVGHVDE

SEQ ID NO: 2076 - protein, 9 aa, Homo Sapiens
AVGHVDEFL

SEQ ID NO: 2077 - protein, 9 aa, Homo Sapiens
VGHVDEFLS

SEQ ID NO: 2078 - protein, 9 aa, Homo Sapiens
DEFLSFVPA

SEQ ID NO: 2079 - protein, 9 aa, Homo Sapiens
LLASPGACF

SEQ ID NO: 2080 - protein, 9 aa, Homo Sapiens
FKLFQEKQK

SEQ ID NO: 2081 - protein, 9 aa, Homo Sapiens
KLFQEKQKC

SEQ ID NO: 2082 - protein, 9 aa, Homo Sapiens
GRALLFQGV

SEQ ID NO: 2083 - protein, 9 aa, Homo Sapiens
FQGVVDDEQ

SEQ ID NO: 2084 - protein, 9 aa, Homo Sapiens
DLINYNKFV

SEQ ID NO: 2085 - protein, 9 aa, Homo Sapiens
INYNKFVQS

SEQ ID NO: 2086 - protein, 9 aa, Homo Sapiens
SCIDWNREV

SEQ ID NO: 2087 - protein, 9 aa, Homo Sapiens
REVLKRELG

SEQ ID NO: 2088 - protein, 9 aa, Homo Sapiens
DIPQLFKTE

SEQ ID NO: 2089 - protein, 9 aa, Homo Sapiens
QLFKTERKK

SEQ ID NO: 2090 - protein, 9 aa, Homo Sapiens
LFKTERKKA

SEQ ID NO: 2091 - protein, 9 aa, Homo Sapiens
KKATAFFPD

SEQ ID NO: 2092 - protein, 9 aa, Homo Sapiens
KATAFFPDL

SEQ ID NO: 2093 - protein, 9 aa, Homo Sapiens
FFPDLVNML

SEQ ID NO: 2094 - protein, 9 aa, Homo Sapiens
DLVNMLVLG

SEQ ID NO: 2095 - protein, 9 aa, Homo Sapiens
IINGCCCLE

SEQ ID NO: 2096 - protein, 9 aa, Homo Sapiens
VRSLLEPLG

SEQ ID NO: 2097 - protein, 9 aa, Homo Sapiens
MLHGEVHCG

SEQ ID NO: 2098 - protein, 9 aa, Homo Sapiens
EVHCGTNVC

SEQ ID NO: 2099 - protein, 9 aa, Homo Sapiens
VHCGTNVCR

SEQ ID NO: 2100 - protein, 9 aa, Homo Sapiens
RKPFSFKWW

SEQ ID NO: 2101 - protein, 9 aa, Homo Sapiens
HPTSAVCVA

SEQ ID NO: 2102 - protein, 9 aa, Homo Sapiens
AVCVAGVET

SEQ ID NO: 2103 - protein, 9 aa, Homo Sapiens
DIYGSVPEG

SEQ ID NO: 2104 - protein, 9 aa, Homo Sapiens
IYGSVPEGT

SEQ ID NO: 2105 - protein, 9 aa, Homo Sapiens
EMFEVYGTP

SEQ ID NO: 2106 - protein, 9 aa, Homo Sapiens
EVYGTPGVD

SEQ ID NO: 2107 - protein, 9 aa, Homo Sapiens
IYISPNMER

SEQ ID NO: 2108 - protein, 9 aa, Homo Sapiens
RWRFDATLE

SEQ ID NO: 2109 - protein, 9 aa, Homo Sapiens
EIIVVMNSP

SEQ ID NO: 2110 - protein, 9 aa, Homo Sapiens
VMNSPSNDL

SEQ ID NO: 2111 - protein, 9 aa, Homo Sapiens
SPSNDLNDS

SEQ ID NO: 2112 - protein, 9 aa, Homo Sapiens
SHVQISYHS

SEQ ID NO: 2113 - protein, 9 aa, Homo Sapiens
VQISYHSSH

SEQ ID NO: 2114 - protein, 9 aa, Homo Sapiens
SYHSSHEPL

SEQ ID NO: 2115 - protein, 9 aa, Homo Sapiens
PLPLAYAVL

SEQ ID NO: 2116 - protein, 9 aa, Homo Sapiens
AVLYLTCVD

SEQ ID NO: 2117 - protein, 9 aa, Homo Sapiens
VLYLTCVDI

SEQ ID NO: 2118 - protein, 9 aa, Homo Sapiens
DISLDCDLN

SEQ ID NO: 2119 - protein, 9 aa, Homo Sapiens
DLNCEGRQD

SEQ ID NO: 2120 - protein, 9 aa, Homo Sapiens
CEGRQDRNF

SEQ ID NO: 2121 - protein, 9 aa, Homo Sapiens
GRQDRNFVD

SEQ ID NO: 2122 - protein, 9 aa, Homo Sapiens
DRNFVDKRQ

SEQ ID NO: 2123 - protein, 9 aa, Homo Sapiens
KRQWVWGPS

SEQ ID NO: 2124 - protein, 9 aa, Homo Sapiens
WVWGPSGYG

SEQ ID NO: 2125 - protein, 9 aa, Homo Sapiens
WGPSGYGGI

SEQ ID NO: 2126 - protein, 9 aa, Homo Sapiens
YGGILLVNC

SEQ ID NO: 2127 - protein, 9 aa, Homo Sapiens
DNCDQHVHC

SEQ ID NO: 2128 - protein, 9 aa, Homo Sapiens
HVHCLQDLE

SEQ ID NO: 2129 - protein, 9 aa, Homo Sapiens
CLQDLEDMS

SEQ ID NO: 2130 - protein, 9 aa, Homo Sapiens
LRTQGPAAL

SEQ ID NO: 2131 - protein, 9 aa, Homo Sapiens
DHKLVLHTS

SEQ ID NO: 2132 - protein, 9 aa, Homo Sapiens
VLHTSSYDA

SEQ ID NO: 2133 - protein, 9 aa, Homo Sapiens
VFHICGPED

SEQ ID NO: 2134 - protein, 9 aa, Homo Sapiens
CEAYRHVLG

SEQ ID NO: 2135 - protein, 9 aa, Homo Sapiens
VPRLHGDEE

SEQ ID NO: 2136 - protein, 9 aa, Homo Sapiens
PRLHGDEER

SEQ ID NO: 2137 - protein, 9 aa, Homo Sapiens
RLHGDEERF

SEQ ID NO: 2138 - protein, 9 aa, Homo Sapiens
GLSFPDAGF

SEQ ID NO: 2139 - protein, 9 aa, Homo Sapiens
TPSTLPPLE

SEQ ID NO: 2140 - protein, 9 aa, Homo Sapiens
LPPLEVYVC

SEQ ID NO: 2141 - protein, 9 aa, Homo Sapiens
PPLEVYVCR

SEQ ID NO: 2142 - protein, 9 aa, Homo Sapiens
VYVCRVRNN

SEQ ID NO: 2143 - protein, 9 aa, Homo Sapiens
VCRVRNNTC

SEQ ID NO: 2144 - protein, 9 aa, Homo Sapiens
VRNNTCFVD

SEQ ID NO: 2145 - protein, 9 aa, Homo Sapiens
WIQDEMELG

SEQ ID NO: 2146 - protein, 9 aa, Homo Sapiens
DEMELGYVQ

SEQ ID NO: 2147 - protein, 9 aa, Homo Sapiens
LGYVQAPHK

SEQ ID NO: 2148 - protein, 9 aa, Homo Sapiens
GYVQAPHKT

SEQ ID NO: 2149 - protein, 9 aa, Homo Sapiens
APHKTLPVV

SEQ ID NO: 2150 - protein, 9 aa, Homo Sapiens
HKTLPVVFD

SEQ ID NO: 2151 - protein, 9 aa, Homo Sapiens
KRILGPDFG

SEQ ID NO: 2152 - protein, 9 aa, Homo Sapiens
LGPDFGYVT

SEQ ID NO: 2153 - protein, 9 aa, Homo Sapiens
DFGYVTREP

SEQ ID NO: 2154 - protein, 9 aa, Homo Sapiens
FGYVTREPR

SEQ ID NO: 2155 - protein, 9 aa, Homo Sapiens
YVTREPRDR

SEQ ID NO: 2156 - protein, 9 aa, Homo Sapiens
REPRDRSVS

SEQ ID NO: 2157 - protein, 9 aa, Homo Sapiens
SFGNLEVSP

SEQ ID NO: 2158 - protein, 9 aa, Homo Sapiens
FGNLEVSPP

SEQ ID NO: 2159 - protein, 9 aa, Homo Sapiens
GNLEVSPPV

SEQ ID NO: 2160 - protein, 9 aa, Homo Sapiens
LEVSPPVVA

SEQ ID NO: 2161 - protein, 9 aa, Homo Sapiens
VANGKEYPL

SEQ ID NO: 2162 - protein, 9 aa, Homo Sapiens
GGNLPGSSG

SEQ ID NO: 2163 - protein, 9 aa, Homo Sapiens
NLPGSSGRR

SEQ ID NO: 2164 - protein, 9 aa, Homo Sapiens
TQVVRDFLH

SEQ ID NO: 2165 - protein, 9 aa, Homo Sapiens
RDFLHAQKV

SEQ ID NO: 2166 - protein, 9 aa, Homo Sapiens
HAQKVQPPV

SEQ ID NO: 2167 - protein, 9 aa, Homo Sapiens
VDWLAVGHV

SEQ ID NO: 2168 - protein, 9 aa, Homo Sapiens
LAVGHVDEF

SEQ ID NO: 2169 - protein, 9 aa, Homo Sapiens
PAPDGKGFR

SEQ ID NO: 2170 - protein, 9 aa, Homo Sapiens
CFKLFQEKQ

SEQ ID NO: 2171 - protein, 9 aa, Homo Sapiens
KQKCGHGRA

SEQ ID NO: 2172 - protein, 9 aa, Homo Sapiens
QKCGHGRAL

SEQ ID NO: 2173 - protein, 9 aa, Homo Sapiens
TISINQVLS

SEQ ID NO: 2174 - protein, 9 aa, Homo Sapiens
INQVLSNKD

SEQ ID NO: 2175 - protein, 9 aa, Homo Sapiens
QVLSNKDLI

SEQ ID NO: 2176 - protein, 9 aa, Homo Sapiens
SNKDLINYN

SEQ ID NO: 2177 - protein, 9 aa, Homo Sapiens
KDLINYNKF

SEQ ID NO: 2178 - protein, 9 aa, Homo Sapiens
NKFVQSCID

SEQ ID NO: 2179 - protein, 9 aa, Homo Sapiens
IDWNREVLK

SEQ ID NO: 2180 - protein, 9 aa, Homo Sapiens
WNREVLKRE

SEQ ID NO: 2181 - protein, 9 aa, Homo Sapiens
DIIDIPQLF

SEQ ID NO: 2182 - protein, 9 aa, Homo Sapiens
VLGKHLGIP

SEQ ID NO: 2183 - protein, 9 aa, Homo Sapiens
HLGIPKPFG

SEQ ID NO: 2184 - protein, 9 aa, Homo Sapiens
FGPIINGCC

SEQ ID NO: 2185 - protein, 9 aa, Homo Sapiens
PIINGCCCL

SEQ ID NO: 2186 - protein, 9 aa, Homo Sapiens
GCCCLEEKV

SEQ ID NO: 2187 - protein, 9 aa, Homo Sapiens
LEPLGLHCT

SEQ ID NO: 2188 - protein, 9 aa, Homo Sapiens
DDFTPYHML

SEQ ID NO: 2189 - protein, 9 aa, Homo Sapiens
HMLHGEVHC

SEQ ID NO: 2190 - protein, 9 aa, Homo Sapiens
LHGEVHCGT

SEQ ID NO: 2191 - protein, 9 aa, Homo Sapiens
VRVSLEHPT

SEQ ID NO: 2192 - protein, 9 aa, Homo Sapiens
AGVETLVDI

SEQ ID NO: 2193 - protein, 9 aa, Homo Sapiens
TLVDIYGSV

SEQ ID NO: 2194 - protein, 9 aa, Homo Sapiens
TEMFEVYGT

SEQ ID NO: 2195 - protein, 9 aa, Homo Sapiens
VDIYISPNM

SEQ ID NO: 2196 - protein, 9 aa, Homo Sapiens
DIYISPNME

SEQ ID NO: 2197 - protein, 9 aa, Homo Sapiens
PNMERGRER

SEQ ID NO: 2198 - protein, 9 aa, Homo Sapiens
MERGRERAD

SEQ ID NO: 2199 - protein, 9 aa, Homo Sapiens
ERGRERADT

SEQ ID NO: 2200 - protein, 9 aa, Homo Sapiens
ERADTRRWR

SEQ ID NO: 2201 - protein, 9 aa, Homo Sapiens
ADTRRWRFD

SEQ ID NO: 2202 - protein, 9 aa, Homo Sapiens
IIVVMNSPS

SEQ ID NO: 2203 - protein, 9 aa, Homo Sapiens
VVMNSPSND

SEQ ID NO: 2204 - protein, 9 aa, Homo Sapiens
NDLNDSHVQ

SEQ ID NO: 2205 - protein, 9 aa, Homo Sapiens
DLNDSHVQI

SEQ ID NO: 2206 - protein, 9 aa, Homo Sapiens
HEPLPLAYA

SEQ ID NO: 2207 - protein, 9 aa, Homo Sapiens
LYLTCVDIS

SEQ ID NO: 2208 - protein, 9 aa, Homo Sapiens
VDISLDCDL

SEQ ID NO: 2209 - protein, 9 aa, Homo Sapiens
LDCDLNCEG

SEQ ID NO: 2210 - protein, 9 aa, Homo Sapiens
EGRQDRNFV

SEQ ID NO: 2211 - protein, 9 aa, Homo Sapiens
NFVDKRQWV

SEQ ID NO: 2212 - protein, 9 aa, Homo Sapiens
DKRQWVWGP

SEQ ID NO: 2213 - protein, 9 aa, Homo Sapiens
RQWVWGPSG

SEQ ID NO: 2214 - protein, 9 aa, Homo Sapiens
GGILLVNCD

SEQ ID NO: 2215 - protein, 9 aa, Homo Sapiens
ILLVNCDRD

SEQ ID NO: 2216 - protein, 9 aa, Homo Sapiens
LLVNCDRDD

SEQ ID NO: 2217 - protein, 9 aa, Homo Sapiens
LVNCDRDDP

SEQ ID NO: 2218 - protein, 9 aa, Homo Sapiens
VNCDRDDPS

SEQ ID NO: 2219 - protein, 9 aa, Homo Sapiens
DPSCDVQDN

SEQ ID NO: 2220 - protein, 9 aa, Homo Sapiens
CDVQDNCDQ

SEQ ID NO: 2221 - protein, 9 aa, Homo Sapiens
QDNCDQHVH

SEQ ID NO: 2222 - protein, 9 aa, Homo Sapiens
QDLEDMSVM

SEQ ID NO: 2223 - protein, 9 aa, Homo Sapiens
VMVLRTQGP

SEQ ID NO: 2224 - protein, 9 aa, Homo Sapiens
AQVFHICGP

SEQ ID NO: 2225 - protein, 9 aa, Homo Sapiens
CGPEDVCEA

SEQ ID NO: 2226 - protein, 9 aa, Homo Sapiens
LGQDKVSYE

SEQ ID NO: 2227 - protein, 9 aa, Homo Sapiens
QDKVSYEVP

SEQ ID NO: 2228 - protein, 9 aa, Homo Sapiens
DKVSYEVPR

SEQ ID NO: 2229 - protein, 9 aa, Homo Sapiens
KVSYEVPRL

SEQ ID NO: 2230 - protein, 9 aa, Homo Sapiens
EERFFVEGL

SEQ ID NO: 2231 - protein, 9 aa, Homo Sapiens
GFTGLISFH

SEQ ID NO: 2232 - protein, 9 aa, Homo Sapiens
GLISFHVTL

SEQ ID NO: 2233 - protein, 9 aa, Homo Sapiens
FHVTLLDDS

SEQ ID NO: 2234 - protein, 9 aa, Homo Sapiens
TLLDDSNED

SEQ ID NO: 2235 - protein, 9 aa, Homo Sapiens
PIFTDTVVF

SEQ ID NO: 2236 - protein, 9 aa, Homo Sapiens
IFTDTVVFR

SEQ ID NO: 2237 - protein, 9 aa, Homo Sapiens
TVVFRVAPW

SEQ ID NO: 2238 - protein, 9 aa, Homo Sapiens
VFRVAPWIM

SEQ ID NO: 2239 - protein, 9 aa, Homo Sapiens
VAPWIMTPS

SEQ ID NO: 2240 - protein, 9 aa, Homo Sapiens
APWIMTPST

SEQ ID NO: 2241 - protein, 9 aa, Homo Sapiens
EVYVCRVRN

SEQ ID NO: 2242 - protein, 9 aa, Homo Sapiens
CRVRNNTCF

SEQ ID NO: 2243 - protein, 9 aa, Homo Sapiens
NNTCFVDAV

SEQ ID NO: 2244 - protein, 9 aa, Homo Sapiens
CFVDAVAEL

SEQ ID NO: 2245 - protein, 9 aa, Homo Sapiens
AELARKAGC

SEQ ID NO: 2246 - protein, 9 aa, Homo Sapiens
ELARKAGCK

SEQ ID NO: 2247 - protein, 9 aa, Homo Sapiens
KLTICPQAE

SEQ ID NO: 2248 - protein, 9 aa, Homo Sapiens
CPQAENRND

SEQ ID NO: 2249 - protein, 9 aa, Homo Sapiens
PQAENRNDR

SEQ ID NO: 2250 - protein, 9 aa, Homo Sapiens
AENRNDRWI

SEQ ID NO: 2251 - protein, 9 aa, Homo Sapiens
ENRNDRWIQ

SEQ ID NO: 2252 - protein, 9 aa, Homo Sapiens
PHKTLPVVF

SEQ ID NO: 2253 - protein, 9 aa, Homo Sapiens
VVFDSPRNG

SEQ ID NO: 2254 - protein, 9 aa, Homo Sapiens
PRNGELQDF

SEQ ID NO: 2255 - protein, 9 aa, Homo Sapiens
GRILIGGNL

SEQ ID NO: 2256 - protein, 9 aa, Homo Sapiens
LIGGNLPGS

SEQ ID NO: 2257 - protein, 9 aa, Homo Sapiens
LPGSSGRRV

SEQ ID NO: 2258 - protein, 9 aa, Homo Sapiens
GRRVTQVVR

SEQ ID NO: 2259 - protein, 9 aa, Homo Sapiens
VVRDFLHAQ

SEQ ID NO: 2260 - protein, 9 aa, Homo Sapiens
DFLHAQKVQ

SEQ ID NO: 2261 - protein, 9 aa, Homo Sapiens
LHAQKVQPP

SEQ ID NO: 2262 - protein, 9 aa, Homo Sapiens
QKVQPPVEL

SEQ ID NO: 2263 - protein, 9 aa, Homo Sapiens
QPPVELFVD

SEQ ID NO: 2264 - protein, 9 aa, Homo Sapiens
LFVDWLAVG

SEQ ID NO: 2265 - protein, 9 aa, Homo Sapiens
EFLSFVPAP

SEQ ID NO: 2266 - protein, 9 aa, Homo Sapiens
FRMLLASPG

SEQ ID NO: 2267 - protein, 9 aa, Homo Sapiens
MLLASPGAC

SEQ ID NO: 2268 - protein, 9 aa, Homo Sapiens
EKQKCGHGR

SEQ ID NO: 2269 - protein, 9 aa, Homo Sapiens
RALLFQGVV

SEQ ID NO: 2270 - protein, 9 aa, Homo Sapiens
GVVDDEQVK

SEQ ID NO: 2271 - protein, 9 aa, Homo Sapiens
VKTISINQV

SEQ ID NO: 2272 - protein, 9 aa, Homo Sapiens
NQVLSNKDL

SEQ ID NO: 2273 - protein, 9 aa, Homo Sapiens
LINYNKFVQ

SEQ ID NO: 2274 - protein, 9 aa, Homo Sapiens
NYNKFVQSC

SEQ ID NO: 2275 - protein, 9 aa, Homo Sapiens
FVQSCIDWN

SEQ ID NO: 2276 - protein, 9 aa, Homo Sapiens
VQSCIDWNR

SEQ ID NO: 2277 - protein, 9 aa, Homo Sapiens
RELGLAECD

SEQ ID NO: 2278 - protein, 9 aa, Homo Sapiens
ELGLAECDI

SEQ ID NO: 2279 - protein, 9 aa, Homo Sapiens
AECDIIDIP

SEQ ID NO: 2280 - protein, 9 aa, Homo Sapiens
FKTERKKAT

SEQ ID NO: 2281 - protein, 9 aa, Homo Sapiens
NMLVLGKHL

SEQ ID NO: 2282 - protein, 9 aa, Homo Sapiens
KHLGIPKPF

SEQ ID NO: 2283 - protein, 9 aa, Homo Sapiens
GPIINGCCC

SEQ ID NO: 2284 - protein, 9 aa, Homo Sapiens
CCCLEEKVR

SEQ ID NO: 2285 - protein, 9 aa, Homo Sapiens
EPLGLHCTF

SEQ ID NO: 2286 - protein, 9 aa, Homo Sapiens
PLGLHCTFI

SEQ ID NO: 2287 - protein, 9 aa, Homo Sapiens
GEVHCGTNV

SEQ ID NO: 2288 - protein, 9 aa, Homo Sapiens
HCGTNVCRK

SEQ ID NO: 2289 - protein, 9 aa, Homo Sapiens
STLAPLEVY

SEQ ID NO: 2290 - protein, 9 aa, Homo Sapiens
IMTPSTLAP

SEQ ID NO: 2291 - protein, 9 aa, Homo Sapiens
PSTLAPLEV

SEQ ID NO: 2292 - protein, 9 aa, Homo Sapiens
MTPSTLAPL

SEQ ID NO: 2293 - protein, 9 aa, Homo Sapiens
TLAPLEVYV

SEQ ID NO: 2294 - protein, 9 aa, Homo Sapiens
WIMTPSTLA

SEQ ID NO: 2295 - protein, 9 aa, Homo Sapiens
APLEVYVCR

SEQ ID NO: 2296 - protein, 9 aa, Homo Sapiens
TPSTLAPLE

SEQ ID NO: 2297 - protein, 9 aa, Homo Sapiens
LAPLEVYVC

SEQ ID NO: 2298 - protein, 9 aa, Homo Sapiens
VPDGKGFRM

SEQ ID NO: 2299 - protein, 9 aa, Homo Sapiens
SFVPVPDGK

SEQ ID NO: 2300 - protein, 9 aa, Homo Sapiens
LSFVPVPDG

SEQ ID NO: 2301 - protein, 9 aa, Homo Sapiens
VPVPDGKGF

SEQ ID NO: 2302 - protein, 9 aa, Homo Sapiens
FLSFVPVPD

SEQ ID NO: 2303 - protein, 9 aa, Homo Sapiens
FVPVPDGKG

SEQ ID NO: 2304 - protein, 9 aa, Homo Sapiens
DEFLSFVPV

SEQ ID NO: 2305 - protein, 9 aa, Homo Sapiens
EFLSFVPVP

SEQ ID NO: 2306 - protein, 9 aa, Homo Sapiens
PVPDGKGFR

SEQ ID NO: 2307 - protein, 9 aa, Homo Sapiens
GLISFHVTL

SEQ ID NO: 2308 - protein, 9 aa, Homo Sapiens
CLEEKVRSL

SEQ ID NO: 2309 - protein, 9 aa, Homo Sapiens
SLEHPTSAV

SEQ ID NO: 2310 - protein, 9 aa, Homo Sapiens
TLPPLEVYV

SEQ ID NO: 2311 - protein, 9 aa, Homo Sapiens
ILGPDFGYV

SEQ ID NO: 2312 - protein, 9 aa, Homo Sapiens
TLVDIYGSV

SEQ ID NO: 2313 - protein, 9 aa, Homo Sapiens
PLAYAVLYL

SEQ ID NO: 2314 - protein, 9 aa, Homo Sapiens
YLTCVDISL

SEQ ID NO: 2315 - protein, 9 aa, Homo Sapiens
ALFDDHKLV

SEQ ID NO: 2316 - protein, 9 aa, Homo Sapiens
LISFHVTLL

SEQ ID NO: 2317 - protein, 9 aa, Homo Sapiens
VMNSPSNDL

SEQ ID NO: 2318 - protein, 9 aa, Homo Sapiens
VLYLTCVDI

SEQ ID NO: 2319 - protein, 9 aa, Homo Sapiens
SGYGGILLV

SEQ ID NO: 2320 - protein, 9 aa, Homo Sapiens
DLNDSHVQI

SEQ ID NO: 2321 - protein, 9 aa, Homo Sapiens
YAVLYLTCV

SEQ ID NO: 2322 - protein, 9 aa, Homo Sapiens
DLEDMSVMV

SEQ ID NO: 2323 - protein, 9 aa, Homo Sapiens
PLEVYVCRV

SEQ ID NO: 2324 - protein, 9 aa, Homo Sapiens
HVDEFLSFV

SEQ ID NO: 2325 - protein, 9 aa, Homo Sapiens
LLFQGVVDD

SEQ ID NO: 2326 - protein, 9 aa, Homo Sapiens
DLINYNKFV

SEQ ID NO: 2327 - protein, 9 aa, Homo Sapiens
LVLGKHLGI

SEQ ID NO: 2328 - protein, 9 aa, Homo Sapiens
SLLEPLGLH

SEQ ID NO: 2329 - protein, 9 aa, Homo Sapiens
ATLEIIVVM

SEQ ID NO: 2330 - protein, 9 aa, Homo Sapiens
AALFDDHKL

SEQ ID NO: 2331 - protein, 9 aa, Homo Sapiens
NLEVSPPVV

SEQ ID NO: 2332 - protein, 9 aa, Homo Sapiens
VANGKEYPL

SEQ ID NO: 2333 - protein, 9 aa, Homo Sapiens
ELFVDWLAV

SEQ ID NO: 2334 - protein, 9 aa, Homo Sapiens
NMLVLGKHL

SEQ ID NO: 2335 - protein, 9 aa, Homo Sapiens
KVRSLLEPL

SEQ ID NO: 2336 - protein, 9 aa, Homo Sapiens
TSAVCVAGV

SEQ ID NO: 2337 - protein, 9 aa, Homo Sapiens
VCVAGVETL

SEQ ID NO: 2338 - protein, 9 aa, Homo Sapiens
PLPLAYAVL

SEQ ID NO: 2339 - protein, 9 aa, Homo Sapiens
KVSYEVPRL

SEQ ID NO: 2340 - protein, 9 aa, Homo Sapiens
FTDTVVFRV

SEQ ID NO: 2341 - protein, 9 aa, Homo Sapiens
MTPSTLPPL

SEQ ID NO: 2342 - protein, 9 aa, Homo Sapiens
CFVDAVAEL

SEQ ID NO: 2343 - protein, 9 aa, Homo Sapiens
ILIGGNLPG

SEQ ID NO: 2344 - protein, 9 aa, Homo Sapiens
PIINGCCCL

SEQ ID NO: 2345 - protein, 9 aa, Homo Sapiens
MSLQRIVRV

SEQ ID NO: 2346 - protein, 9 aa, Homo Sapiens
CVAGVETLV

SEQ ID NO: 2347 - protein, 9 aa, Homo Sapiens
AGVETLVDI

SEQ ID NO: 2348 - protein, 9 aa, Homo Sapiens
LARKAGCKL

SEQ ID NO: 2349 - protein, 9 aa, Homo Sapiens
YVQAPHKTL

SEQ ID NO: 2350 - protein, 9 aa, Homo Sapiens
QAPHKTLPV

SEQ ID NO: 2351 - protein, 9 aa, Homo Sapiens
LIGGNLPGS

SEQ ID NO: 2352 - protein, 9 aa, Homo Sapiens
CIDWNREVL

SEQ ID NO: 2353 - protein, 9 aa, Homo Sapiens
VLKRELGLA

SEQ ID NO: 2354 - protein, 9 aa, Homo Sapiens
ATAFFPDLV

SEQ ID NO: 2355 - protein, 9 aa, Homo Sapiens
FFPDLVNML

SEQ ID NO: 2356 - protein, 9 aa, Homo Sapiens
GIPKPFGPI

SEQ ID NO: 2357 - protein, 9 aa, Homo Sapiens
DIYGSVPEG

SEQ ID NO: 2358 - protein, 9 aa, Homo Sapiens
SLDCDLNCE

SEQ ID NO: 2359 - protein, 9 aa, Homo Sapiens
VLRTQGPAA

SEQ ID NO: 2360 - protein, 9 aa, Homo Sapiens
ASPIFTDTV

SEQ ID NO: 2361 - protein, 9 aa, Homo Sapiens
AVAELARKA

SEQ ID NO: 2362 - protein, 9 aa, Homo Sapiens
APHKTLPVV

SEQ ID NO: 2363 - protein, 9 aa, Homo Sapiens
LLASPGACF

SEQ ID NO: 2364 - protein, 9 aa, Homo Sapiens
RALLFQGVV

SEQ ID NO: 2365 - protein, 9 aa, Homo Sapiens
KTISINQVL

SEQ ID NO: 2366 - protein, 9 aa, Homo Sapiens
SCIDWNREV

SEQ ID NO: 2367 - protein, 9 aa, Homo Sapiens
LAECDIIDI

SEQ ID NO: 2368 - protein, 9 aa, Homo Sapiens
CDIIDIPQL

SEQ ID NO: 2369 - protein, 9 aa, Homo Sapiens
MLHGEVHCG

SEQ ID NO: 2370 - protein, 9 aa, Homo Sapiens
SLQRIVRVS

SEQ ID NO: 2371 - protein, 9 aa, Homo Sapiens
LQRIVRVSL

SEQ ID NO: 2372 - protein, 9 aa, Homo Sapiens
FEVYGTPGV

SEQ ID NO: 2373 - protein, 9 aa, Homo Sapiens
RRWRFDATL

SEQ ID NO: 2374 - protein, 9 aa, Homo Sapiens
DATLEIIVV

SEQ ID NO: 2375 - protein, 9 aa, Homo Sapiens
LAYAVLYLT

SEQ ID NO: 2376 - protein, 9 aa, Homo Sapiens
LEDMSVMVL

SEQ ID NO: 2377 - protein, 9 aa, Homo Sapiens
DMSVMVLRT

SEQ ID NO: 2378 - protein, 9 aa, Homo Sapiens
LRTQGPAAL

SEQ ID NO: 2379 - protein, 9 aa, Homo Sapiens
VLHTSSYDA

SEQ ID NO: 2380 - protein, 9 aa, Homo Sapiens
TLLDDSNED

SEQ ID NO: 2381 - protein, 9 aa, Homo Sapiens
RVRNNTCFV

SEQ ID NO: 2382 - protein, 9 aa, Homo Sapiens
LDSFGNLEV

SEQ ID NO: 2383 - protein, 9 aa, Homo Sapiens
GNLEVSPPV

SEQ ID NO: 2384 - protein, 9 aa, Homo Sapiens
SSGRRVTQV

SEQ ID NO: 2385 - protein, 9 aa, Homo Sapiens
VDWLAVGHV

SEQ ID NO: 2386 - protein, 9 aa, Homo Sapiens
WLAVGHVDE

SEQ ID NO: 2387 - protein, 9 aa, Homo Sapiens
AVGHVDEFL

SEQ ID NO: 2388 - protein, 9 aa, Homo Sapiens
RMLLASPGA

SEQ ID NO: 2389 - protein, 9 aa, Homo Sapiens
ASPGACFKL

SEQ ID NO: 2390 - protein, 9 aa, Homo Sapiens
VDDEQVKTI

SEQ ID NO: 2391 - protein, 9 aa, Homo Sapiens
IDIPQLFKT

SEQ ID NO: 2392 - protein, 9 aa, Homo Sapiens
KATAFFPDL

SEQ ID NO: 2393 - protein, 9 aa, Homo Sapiens
GTPGVDIYI

SEQ ID NO: 2394 - protein, 9 aa, Homo Sapiens
WRFDATLEI

SEQ ID NO: 2395 - protein, 9 aa, Homo Sapiens
TLEIIVVMN

SEQ ID NO: 2396 - protein, 9 aa, Homo Sapiens
NCDQHVHCL

SEQ ID NO: 2397 - protein, 9 aa, Homo Sapiens
KLVLHTSSY

SEQ ID NO: 2398 - protein, 9 aa, Homo Sapiens
SYDAKRAQV

SEQ ID NO: 2399 - protein, 9 aa, Homo Sapiens
FHICGPEDV

SEQ ID NO: 2400 - protein, 9 aa, Homo Sapiens
DVCEAYRHV

SEQ ID NO: 2401 - protein, 9 aa, Homo Sapiens
VLGQDKVSY

SEQ ID NO: 2402 - protein, 9 aa, Homo Sapiens
FTGLISFHV

SEQ ID NO: 2403 - protein, 9 aa, Homo Sapiens
VVFRVAPWI

SEQ ID NO: 2404 - protein, 9 aa, Homo Sapiens
STLPPLEVY

SEQ ID NO: 2405 - protein, 9 aa, Homo Sapiens
NNTCFVDAV

SEQ ID NO: 2406 - protein, 9 aa, Homo Sapiens
RKAGCKLTI

SEQ ID NO: 2407 - protein, 9 aa, Homo Sapiens
FDSPRNGEL

SEQ ID NO: 2408 - protein, 9 aa, Homo Sapiens
SGLDSFGNL

SEQ ID NO: 2409 - protein, 9 aa, Homo Sapiens
KEYPLGRIL

SEQ ID NO: 2410 - protein, 9 aa, Homo Sapiens
VTQVVRDFL

SEQ ID NO: 2411 - protein, 9 aa, Homo Sapiens
HAQKVQPPV

SEQ ID NO: 2412 - protein, 9 aa, Homo Sapiens
QKVQPPVEL

SEQ ID NO: 2413 - protein, 9 aa, Homo Sapiens
PVELFVDWL

SEQ ID NO: 2414 - protein, 9 aa, Homo Sapiens
KCGHGRALL

SEQ ID NO: 2415 - protein, 9 aa, Homo Sapiens
GRALLFQGV

SEQ ID NO: 2416 - protein, 9 aa, Homo Sapiens
ALLFQGVVD

SEQ ID NO: 2417 - protein, 9 aa, Homo Sapiens
VKTISINQV

SEQ ID NO: 2418 - protein, 9 aa, Homo Sapiens
SINQVLSNK

SEQ ID NO: 2419 - protein, 9 aa, Homo Sapiens
EVLKRELGL

SEQ ID NO: 2420 - protein, 9 aa, Homo Sapiens
ELGLAECDI

SEQ ID NO: 2421 - protein, 9 aa, Homo Sapiens
GLAECDIID

SEQ ID NO: 2422 - protein, 9 aa, Homo Sapiens
AFFPDLVNM

SEQ ID NO: 2423 - protein, 9 aa, Homo Sapiens
DLVNMLVLG

SEQ ID NO: 2424 - protein, 9 aa, Homo Sapiens
VLGKHLGIP

SEQ ID NO: 2425 - protein, 9 aa, Homo Sapiens
LLEPLGLHC

SEQ ID NO: 2426 - protein, 9 aa, Homo Sapiens
PLGLHCTFI

SEQ ID NO: 2427 - protein, 9 aa, Homo Sapiens
AVCVAGVET

SEQ ID NO: 2428 - protein, 9 aa, Homo Sapiens
FDATLEIIV

SEQ ID NO: 2429 - protein, 9 aa, Homo Sapiens
SSHEPLPLA

SEQ ID NO: 2430 - protein, 9 aa, Homo Sapiens
EPLPLAYAV

SEQ ID NO: 2431 - protein, 9 aa, Homo Sapiens
VDISLDCDL

SEQ ID NO: 2432 - protein, 9 aa, Homo Sapiens
GPSGYGGIL

SEQ ID NO: 2433 - protein, 9 aa, Homo Sapiens
ILLVNCDRD

SEQ ID NO: 2434 - protein, 9 aa, Homo Sapiens
QHVHCLQDL

SEQ ID NO: 2435 - protein, 9 aa, Homo Sapiens
LQDLEDMSV

SEQ ID NO: 2436 - protein, 9 aa, Homo Sapiens
LFDDHKLVL

SEQ ID NO: 2437 - protein, 9 aa, Homo Sapiens
AKRAQVFHI

SEQ ID NO: 2438 - protein, 9 aa, Homo Sapiens
RHVLGQDKV

SEQ ID NO: 2439 - protein, 9 aa, Homo Sapiens
GQDKVSYEV

SEQ ID NO: 2440 - protein, 9 aa, Homo Sapiens
GLSFPDAGF

SEQ ID NO: 2441 - protein, 9 aa, Homo Sapiens
FPDAGFTGL

SEQ ID NO: 2442 - protein, 9 aa, Homo Sapiens
RVAPWIMTP

SEQ ID NO: 2443 - protein, 9 aa, Homo Sapiens
IMTPSTLPP

SEQ ID NO: 2444 - protein, 9 aa, Homo Sapiens
RWIQDEMEL

SEQ ID NO: 2445 - protein, 9 aa, Homo Sapiens
QDFPYKRIL

SEQ ID NO: 2446 - protein, 9 aa, Homo Sapiens
RILGPDFGY

SEQ ID NO: 2447 - protein, 9 aa, Homo Sapiens
SGRRVTQVV

SEQ ID NO: 2448 - protein, 9 aa, Homo Sapiens
VQPPVELFV

SEQ ID NO: 2449 - protein, 9 aa, Homo Sapiens
LAVGHVDEF

SEQ ID NO: 2450 - protein, 9 aa, Homo Sapiens
KLFQEKQKC

SEQ ID NO: 2451 - protein, 9 aa, Homo Sapiens
VVDDEQVKT

SEQ ID NO: 2452 - protein, 9 aa, Homo Sapiens
QVLSNKDLI

SEQ ID NO: 2453 - protein, 9 aa, Homo Sapiens
LVNMLVLGK

SEQ ID NO: 2454 - protein, 9 aa, Homo Sapiens
GCCCLEEKV

SEQ ID NO: 2455 - protein, 9 aa, Homo Sapiens
RSLLEPLGL

SEQ ID NO: 2456 - protein, 9 aa, Homo Sapiens
FIDDFTPYH

SEQ ID NO: 2457 - protein, 9 aa, Homo Sapiens
HMLHGEVHC

SEQ ID NO: 2458 - protein, 9 aa, Homo Sapiens
NMERGRERA

SEQ ID NO: 2459 - protein, 9 aa, Homo Sapiens
LLDDSNEDF

SEQ ID NO: 2460 - protein, 9 aa, Homo Sapiens
SPIFTDTVV

SEQ ID NO: 2461 - protein, 9 aa, Homo Sapiens
LTICPQAEN

SEQ ID NO: 2462 - protein, 9 aa, Homo Sapiens
QDEMELGYV

SEQ ID NO: 2463 - protein, 9 aa, Homo Sapiens
KTLPVVFDS

SEQ ID NO: 2464 - protein, 9 aa, Homo Sapiens
TREPRDRSV

SEQ ID NO: 2465 - protein, 9 aa, Homo Sapiens
GLDSFGNLE

SEQ ID NO: 2466 - protein, 9 aa, Homo Sapiens
GRILIGGNL

SEQ ID NO: 2467 - protein, 9 aa, Homo Sapiens
RILIGGNLP

SEQ ID NO: 2468 - protein, 9 aa, Homo Sapiens
VVRDFLHAQ

SEQ ID NO: 2469 - protein, 9 aa, Homo Sapiens
RDFLHAQKV

SEQ ID NO: 2470 - protein, 9 aa, Homo Sapiens
FLHAQKVQP

SEQ ID NO: 2471 - protein, 9 aa, Homo Sapiens
MLLASPGAC

SEQ ID NO: 2472 - protein, 9 aa, Homo Sapiens
QKCGHGRAL

SEQ ID NO: 2473 - protein, 9 aa, Homo Sapiens
VLSNKDLIN

SEQ ID NO: 2474 - protein, 9 aa, Homo Sapiens
QLFKTERKK

SEQ ID NO: 2475 - protein, 9 aa, Homo Sapiens
KTERKKATA

SEQ ID NO: 2476 - protein, 9 aa, Homo Sapiens
MLVLGKHLG

SEQ ID NO: 2477 - protein, 9 aa, Homo Sapiens
IPKPFGPII

SEQ ID NO: 2478 - protein, 9 aa, Homo Sapiens
IINGCCCLE

SEQ ID NO: 2479 - protein, 9 aa, Homo Sapiens
LEPLGLHCT

SEQ ID NO: 2480 - protein, 9 aa, Homo Sapiens
FSFKWWNMV

SEQ ID NO: 2481 - protein, 9 aa, Homo Sapiens
SVPEGTEMF

SEQ ID NO: 2482 - protein, 9 aa, Homo Sapiens
VYGTPGVDI

SEQ ID NO: 2483 - protein, 9 aa, Homo Sapiens
YISPNMERG

SEQ ID NO: 2484 - protein, 9 aa, Homo Sapiens
RFDATLEII

SEQ ID NO: 2485 - protein, 9 aa, Homo Sapiens
SNDLNDSHV

SEQ ID NO: 2486 - protein, 9 aa, Homo Sapiens
SYHSSHEPL

SEQ ID NO: 2487 - protein, 9 aa, Homo Sapiens
NFVDKRQWV

SEQ ID NO: 2488 - protein, 9 aa, Homo Sapiens
LLVNCDRDD

SEQ ID NO: 2489 - protein, 9 aa, Homo Sapiens
CLQDLEDMS

SEQ ID NO: 2490 - protein, 9 aa, Homo Sapiens
VMVLRTQGP

SEQ ID NO: 2491 - protein, 9 aa, Homo Sapiens
CGPEDVCEA

SEQ ID NO: 2492 - protein, 9 aa, Homo Sapiens
VCEAYRHVL

SEQ ID NO: 2493 - protein, 9 aa, Homo Sapiens
RLHGDEERF

SEQ ID NO: 2494 - protein, 9 aa, Homo Sapiens
HGDEERFFV

SEQ ID NO: 2495 - protein, 9 aa, Homo Sapiens
EERFFVEGL

SEQ ID NO: 2496 - protein, 9 aa, Homo Sapiens
PDAGFTGLI

SEQ ID NO: 2497 - protein, 9 aa, Homo Sapiens
SASPIFTDT

SEQ ID NO: 2498 - protein, 9 aa, Homo Sapiens
APWIMTPST

SEQ ID NO: 2499 - protein, 9 aa, Homo Sapiens
EMELGYVQA

SEQ ID NO: 2500 - protein, 9 aa, Homo Sapiens
TLPVVFDSP

SEQ ID NO: 2501 - protein, 9 aa, Homo Sapiens
ELQDFPYKR

SEQ ID NO: 2502 - protein, 9 aa, Homo Sapiens
PRDRSVSGL

SEQ ID NO: 2503 - protein, 9 aa, Homo Sapiens
GKEYPLGRI

SEQ ID NO: 2504 - protein, 9 aa, Homo Sapiens
PLGRILIGG

SEQ ID NO: 2505 - protein, 9 aa, Homo Sapiens
NLPGSSGRR

SEQ ID NO: 2506 - protein, 9 aa, Homo Sapiens
LPGSSGRRV

SEQ ID NO: 2507 - protein, 9 aa, Homo Sapiens
KVQPPVELF

SEQ ID NO: 2508 - protein, 9 aa, Homo Sapiens
FLSFVPAPD

SEQ ID NO: 2509 - protein, 9 aa, Homo Sapiens
DEQVKTISI

SEQ ID NO: 2510 - protein, 9 aa, Homo Sapiens
NREVLKREL

SEQ ID NO: 2511 - protein, 9 aa, Homo Sapiens
LGLAECDII

SEQ ID NO: 2512 - protein, 9 aa, Homo Sapiens
IIDIPQLFK

SEQ ID NO: 2513 - protein, 9 aa, Homo Sapiens
HLGIPKPFG

SEQ ID NO: 2514 - protein, 9 aa, Homo Sapiens
DDFTPYHML

SEQ ID NO: 2515 - protein, 9 aa, Homo Sapiens
RIVRVSLEH

SEQ ID NO: 2516 - protein, 9 aa, Homo Sapiens
VSLEHPTSA

SEQ ID NO: 2517 - protein, 9 aa, Homo Sapiens
HSSHEPLPL

SEQ ID NO: 2518 - protein, 9 aa, Homo Sapiens
HEPLPLAYA

SEQ ID NO: 2519 - protein, 9 aa, Homo Sapiens
WGPSGYGGI

SEQ ID NO: 2520 - protein, 9 aa, Homo Sapiens
GILLVNCDR

SEQ ID NO: 2521 - protein, 9 aa, Homo Sapiens
DRDDPSCDV

SEQ ID NO: 2522 - protein, 9 aa, Homo Sapiens
VQDNCDQHV

SEQ ID NO: 2523 - protein, 9 aa, Homo Sapiens
HICGPEDVC

SEQ ID NO: 2524 - protein, 9 aa, Homo Sapiens
AGFTGLISF

SEQ ID NO: 2525 - protein, 9 aa, Homo Sapiens
PWIMTPSTL

SEQ ID NO: 2526 - protein, 9 aa, Homo Sapiens
YVCRVRNNT

SEQ ID NO: 2527 - protein, 9 aa, Homo Sapiens
KLTICPQAE

SEQ ID NO: 2528 - protein, 9 aa, Homo Sapiens
AENRNDRWI

SEQ ID NO: 2529 - protein, 9 aa, Homo Sapiens
EVSPPVVAN

SEQ ID NO: 2530 - protein, 9 aa, Homo Sapiens
YPLGRILIG

SEQ ID NO: 2531 - protein, 9 aa, Homo Sapiens
DGKGFRMLL

SEQ ID NO: 2532 - protein, 9 aa, Homo Sapiens
ISINQVLSN

SEQ ID NO: 2533 - protein, 9 aa, Homo Sapiens
FPDLVNMLV

SEQ ID NO: 2534 - protein, 9 aa, Homo Sapiens
LEEKVRSLL

SEQ ID NO: 2535 - protein, 9 aa, Homo Sapiens
GLHCTFIDD

SEQ ID NO: 2536 - protein, 9 aa, Homo Sapiens
GEVHCGTNV

SEQ ID NO: 2537 - protein, 9 aa, Homo Sapiens
IVRVSLEHP

SEQ ID NO: 2538 - protein, 9 aa, Homo Sapiens
TEMFEVYGT

SEQ ID NO: 2539 - protein, 9 aa, Homo Sapiens
EMFEVYGTP

SEQ ID NO: 2540 - protein, 9 aa, Homo Sapiens
GVDIYISPN

SEQ ID NO: 2541 - protein, 9 aa, Homo Sapiens
EIIVVMNSP

SEQ ID NO: 2542 - protein, 9 aa, Homo Sapiens
IIVVMNSPS

SEQ ID NO: 2543 - protein, 9 aa, Homo Sapiens
AVLYLTCVD

SEQ ID NO: 2544 - protein, 9 aa, Homo Sapiens
LTCVDISLD

SEQ ID NO: 2545 - protein, 9 aa, Homo Sapiens
DLNCEGRQD

SEQ ID NO: 2546 - protein, 9 aa, Homo Sapiens
HCLQDLEDM

SEQ ID NO: 2547 - protein, 9 aa, Homo Sapiens
MVLRTQGPA

SEQ ID NO: 2548 - protein, 9 aa, Homo Sapiens
YEVPRLHGD

SEQ ID NO: 2549 - protein, 9 aa, Homo Sapiens
FSASPIFTD

SEQ ID NO: 2550 - protein, 9 aa, Homo Sapiens
PIFTDTVVF

SEQ ID NO: 2551 - protein, 9 aa, Homo Sapiens
WIMTPSTLP

SEQ ID NO: 2552 - protein, 9 aa, Homo Sapiens
PSTLPPLEV

SEQ ID NO: 2553 - protein, 9 aa, Homo Sapiens
ELARKAGCK

SEQ ID NO: 2554 - protein, 9 aa, Homo Sapiens
KAGCKLTIC

SEQ ID NO: 2555 - protein, 9 aa, Homo Sapiens
TICPQAENR

SEQ ID NO: 2556 - protein, 9 aa, Homo Sapiens
MELGYVQAP

SEQ ID NO: 2557 - protein, 9 aa, Homo Sapiens
GFRMLLASP

SEQ ID NO: 2558 - protein, 9 aa, Homo Sapiens
LASPGACFK

SEQ ID NO: 2559 - protein, 9 aa, Homo Sapiens
QGVVDDEQV

SEQ ID NO: 2560 - protein, 9 aa, Homo Sapiens
TISINQVLS

SEQ ID NO: 2561 - protein, 9 aa, Homo Sapiens
LINYNKFVQ

SEQ ID NO: 2562 - protein, 9 aa, Homo Sapiens
KRELGLAEC

SEQ ID NO: 2563 - protein, 9 aa, Homo Sapiens
DIIDIPQLF

SEQ ID NO: 2564 - protein, 9 aa, Homo Sapiens
PDLVNMLVL

SEQ ID NO: 2565 - protein, 9 aa, Homo Sapiens
GKHLGIPKP

SEQ ID NO: 2566 - protein, 9 aa, Homo Sapiens
PYHMLHGEV

SEQ ID NO: 2567 - protein, 9 aa, Homo Sapiens
EHPTSAVCV

SEQ ID NO: 2568 - protein, 9 aa, Homo Sapiens
GVETLVDIY

SEQ ID NO: 2569 - protein, 9 aa, Homo Sapiens
ETLVDIYGS

SEQ ID NO: 2570 - protein, 9 aa, Homo Sapiens
GSVPEGTEM

SEQ ID NO: 2571 - protein, 9 aa, Homo Sapiens
PEGTEMFEV

SEQ ID NO: 2572 - protein, 9 aa, Homo Sapiens
YGTPGVDIY

SEQ ID NO: 2573 - protein, 9 aa, Homo Sapiens
DIYISPNME

SEQ ID NO: 2574 - protein, 9 aa, Homo Sapiens
IVVMNSPSN

SEQ ID NO: 2575 - protein, 9 aa, Homo Sapiens
YGGILLVNC

SEQ ID NO: 2576 - protein, 9 aa, Homo Sapiens
GGILLVNCD

SEQ ID NO: 2577 - protein, 9 aa, Homo Sapiens
RTQGPAALF

SEQ ID NO: 2578 - protein, 9 aa, Homo Sapiens
DDHKLVLHT

SEQ ID NO: 2579 - protein, 9 aa, Homo Sapiens
HTSSYDAKR

SEQ ID NO: 2580 - protein, 9 aa, Homo Sapiens
FFVEGLSFP

SEQ ID NO: 2581 - protein, 9 aa, Homo Sapiens
LSFPDAGFT

SEQ ID NO: 2582 - protein, 9 aa, Homo Sapiens
TVVFRVAPW

SEQ ID NO: 2583 - protein, 9 aa, Homo Sapiens
NTCFVDAVA

SEQ ID NO: 2584 - protein, 9 aa, Homo Sapiens
FVDAVAELA

SEQ ID NO: 2585 - protein, 9 aa, Homo Sapiens
DAVAELARK

SEQ ID NO: 2586 - protein, 9 aa, Homo Sapiens
WIQDEMELG

SEQ ID NO: 2587 - protein, 9 aa, Homo Sapiens
LQDFPYKRI

SEQ ID NO: 2588 - protein, 9 aa, Homo Sapiens
LGPDFGYVT

SEQ ID NO: 2589 - protein, 9 aa, Homo Sapiens
SVSGLDSFG

SEQ ID NO: 2590 - protein, 9 aa, Homo Sapiens
LEVSPPVVA

SEQ ID NO: 2591 - protein, 9 aa, Homo Sapiens
VSPPVVANG

SEQ ID NO: 2592 - protein, 9 aa, Homo Sapiens
VVANGKEYP

SEQ ID NO: 2593 - protein, 9 aa, Homo Sapiens
QVVRDFLHA

SEQ ID NO: 2594 - protein, 9 aa, Homo Sapiens
LHAQKVQPP

SEQ ID NO: 2595 - protein, 9 aa, Homo Sapiens
LFVDWLAVG

SEQ ID NO: 2596 - protein, 9 aa, Homo Sapiens
FVDWLAVGH

SEQ ID NO: 2597 - protein, 9 aa, Homo Sapiens
APDGKGFRM

SEQ ID NO: 2598 - protein, 9 aa, Homo Sapiens
PDGKGFRML

SEQ ID NO: 2599 - protein, 9 aa, Homo Sapiens
GACFKLFQE

SEQ ID NO: 2600 - protein, 9 aa, Homo Sapiens
NQVLSNKDL

SEQ ID NO: 2601 - protein, 9 aa, Homo Sapiens
FVQSCIDWN

SEQ ID NO: 2602 - protein, 9 aa, Homo Sapiens
DIPQLFKTE

SEQ ID NO: 2603 - protein, 9 aa, Homo Sapiens
KPFGPIING

SEQ ID NO: 2604 - protein, 9 aa, Homo Sapiens
LHGEVHCGT

SEQ ID NO: 2605 - protein, 9 aa, Homo Sapiens
VAGVETLVD

SEQ ID NO: 2606 - protein, 9 aa, Homo Sapiens
LEIIVVMNS

SEQ ID NO: 2607 - protein, 9 aa, Homo Sapiens
AYAVLYLTC

SEQ ID NO: 2608 - protein, 9 aa, Homo Sapiens
LYLTCVDIS

SEQ ID NO: 2609 - protein, 9 aa, Homo Sapiens
CVDISLDCD

SEQ ID NO: 2610 - protein, 9 aa, Homo Sapiens
EGRQDRNFV

SEQ ID NO: 2611 - protein, 9 aa, Homo Sapiens
WVWGPSGYG

SEQ ID NO: 2612 - protein, 9 aa, Homo Sapiens
PSGYGGILL

SEQ ID NO: 2613 - protein, 9 aa, Homo Sapiens
GYGGILLVN

SEQ ID NO: 2614 - protein, 9 aa, Homo Sapiens
QDLEDMSVM

SEQ ID NO: 2615 - protein, 9 aa, Homo Sapiens
SVMVLRTQG

SEQ ID NO: 2616 - protein, 9 aa, Homo Sapiens
FDDHKLVLH

SEQ ID NO: 2617 - protein, 9 aa, Homo Sapiens
LVLHTSSYD

SEQ ID NO: 2618 - protein, 9 aa, Homo Sapiens
EAYRHVLGQ

SEQ ID NO: 2619 - protein, 9 aa, Homo Sapiens
LGQDKVSYE

SEQ ID NO: 2620 - protein, 9 aa, Homo Sapiens
IFTDTVVFR

SEQ ID NO: 2621 - protein, 9 aa, Homo Sapiens
ELGYVQAPH

SEQ ID NO: 2622 - protein, 9 aa, Homo Sapiens
GYVQAPHKT

SEQ ID NO: 2623 - protein, 9 aa, Homo Sapiens
FPYKRILGP

SEQ ID NO: 2624 - protein, 9 aa, Homo Sapiens
VTREPRDRS

SEQ ID NO: 2625 - protein, 9 aa, Homo Sapiens
RSVSGLDSF

SEQ ID NO: 2626 - protein, 9 aa, Homo Sapiens
LGRILIGGN

SEQ ID NO: 2627 - protein, 9 aa, Homo Sapiens
GNLPGSSGR

SEQ ID NO: 2628 - protein, 9 aa, Homo Sapiens
FVPAPDGKG

SEQ ID NO: 2629 - protein, 9 aa, Homo Sapiens
KGFRMLLAS

SEQ ID NO: 2630 - protein, 9 aa, Homo Sapiens
LFQGVVDDE

SEQ ID NO: 2631 - protein, 9 aa, Homo Sapiens
SNKDLINYN

SEQ ID NO: 2632 - protein, 9 aa, Homo Sapiens
NYNKFVQSC

SEQ ID NO: 2633 - protein, 9 aa, Homo Sapiens
YNKFVQSCI

SEQ ID NO: 2634 - protein, 9 aa, Homo Sapiens
VNMLVLGKH

SEQ ID NO: 2635 - protein, 9 aa, Homo Sapiens
LGIPKPFGP

SEQ ID NO: 2636 - protein, 9 aa, Homo Sapiens
VRVSLEHPT

SEQ ID NO: 2637 - protein, 9 aa, Homo Sapiens
RVSLEHPTS

SEQ ID NO: 2638 - protein, 9 aa, Homo Sapiens
HPTSAVCVA

SEQ ID NO: 2639 - protein, 9 aa, Homo Sapiens
LVDIYGSVP

SEQ ID NO: 2640 - protein, 9 aa, Homo Sapiens
IYGSVPEGT

SEQ ID NO: 2641 - protein, 9 aa, Homo Sapiens
GTEMFEVYG

SEQ ID NO: 2642 - protein, 9 aa, Homo Sapiens
VDIYISPNM

SEQ ID NO: 2643 - protein, 9 aa, Homo Sapiens
IYISPNMER

SEQ ID NO: 2644 - protein, 9 aa, Homo Sapiens
DTRRWRFDA

SEQ ID NO: 2645 - protein, 9 aa, Homo Sapiens
SPSNDLNDS

SEQ ID NO: 2646 - protein, 9 aa, Homo Sapiens
HVQISYHSS

SEQ ID NO: 2647 - protein, 9 aa, Homo Sapiens
QISYHSSHE

SEQ ID NO: 2648 - protein, 9 aa, Homo Sapiens
LPLAYAVLY

SEQ ID NO: 2649 - protein, 9 aa, Homo Sapiens
DISLDCDLN

SEQ ID NO: 2650 - protein, 9 aa, Homo Sapiens
QDRNFVDKR

SEQ ID NO: 2651 - protein, 9 aa, Homo Sapiens
LVNCDRDDP

SEQ ID NO: 2652 - protein, 9 aa, Homo Sapiens
HVLGQDKVS

SEQ ID NO: 2653 - protein, 9 aa, Homo Sapiens
FVEGLSFPD

SEQ ID NO: 2654 - protein, 9 aa, Homo Sapiens
GFTGLISFH

SEQ ID NO: 2655 - protein, 9 aa, Homo Sapiens
TGLISFHVT

SEQ ID NO: 2656 - protein, 9 aa, Homo Sapiens
SFHVTLLDD

SEQ ID NO: 2657 - protein, 9 aa, Homo Sapiens
VTLLDDSNE

SEQ ID NO: 2658 - protein, 9 aa, Homo Sapiens
SNEDFSASP

SEQ ID NO: 2659 - protein, 9 aa, Homo Sapiens
NEDFSASPI

SEQ ID NO: 2660 - protein, 9 aa, Homo Sapiens
DTVVFRVAP

SEQ ID NO: 2661 - protein, 9 aa, Homo Sapiens
LPPLEVYVC

SEQ ID NO: 2662 - protein, 9 aa, Homo Sapiens
RNNTCFVDA

SEQ ID NO: 2663 - protein, 9 aa, Homo Sapiens
AELARKAGC

SEQ ID NO: 2664 - protein, 9 aa, Homo Sapiens
CKLTICPQA

SEQ ID NO: 2665 - protein, 9 aa, Homo Sapiens
VVFDSPRNG

SEQ ID NO: 2666 - protein, 9 aa, Homo Sapiens
SFGNLEVSP

SEQ ID NO: 2667 - protein, 9 aa, Homo Sapiens
EYPLGRILI

SEQ ID NO: 2668 - protein, 9 aa, Homo Sapiens
GSSGRRVTQ

SEQ ID NO: 2669 - protein, 9 aa, Homo Sapiens
RVTQVVRDF

SEQ ID NO: 2670 - protein, 9 aa, Homo Sapiens
LSNKDLINY

SEQ ID NO: 2671 - protein, 9 aa, Homo Sapiens
DWNREVLKR

SEQ ID NO: 2672 - protein, 9 aa, Homo Sapiens
LKRELGLAE

SEQ ID NO: 2673 - protein, 9 aa, Homo Sapiens
AECDIIDIP

SEQ ID NO: 2674 - protein, 9 aa, Homo Sapiens
LHCTFIDDF

SEQ ID NO: 2675 - protein, 9 aa, Homo Sapiens
CTFIDDFTP

SEQ ID NO: 2676 - protein, 9 aa, Homo Sapiens
TPYHMLHGE

SEQ ID NO: 2677 - protein, 9 aa, Homo Sapiens
NVCRKPFSF

SEQ ID NO: 2678 - protein, 9 aa, Homo Sapiens
QRIVRVSLE

SEQ ID NO: 2679 - protein, 9 aa, Homo Sapiens
LEHPTSAVC

SEQ ID NO: 2680 - protein, 9 aa, Homo Sapiens
SAVCVAGVE

SEQ ID NO: 2681 - protein, 9 aa, Homo Sapiens
VDIYGSVPE

SEQ ID NO: 2682 - protein, 9 aa, Homo Sapiens
VVMNSPSND

SEQ ID NO: 2683 - protein, 9 aa, Homo Sapiens
LNDSHVQIS

SEQ ID NO: 2684 - protein, 9 aa, Homo Sapiens
VQISYHSSH

SEQ ID NO: 2685 - protein, 9 aa, Homo Sapiens
ISYHSSHEP

SEQ ID NO: 2686 - protein, 9 aa, Homo Sapiens
SHEPLPLAY

SEQ ID NO: 2687 - protein, 9 aa, Homo Sapiens
ISLDCDLNC

SEQ ID NO: 2688 - protein, 9 aa, Homo Sapiens
LDCDLNCEG

SEQ ID NO: 2689 - protein, 9 aa, Homo Sapiens
LNCEGRQDR

SEQ ID NO: 2690 - protein, 9 aa, Homo Sapiens
MSVMVLRTQ

SEQ ID NO: 2691 - protein, 9 aa, Homo Sapiens
AQVFHICGP

SEQ ID NO: 2692 - protein, 9 aa, Homo Sapiens
ICGPEDVCE

SEQ ID NO: 2693 - protein, 9 aa, Homo Sapiens
AYRHVLGQD

SEQ ID NO: 2694 - protein, 9 aa, Homo Sapiens
VEGLSFPDA

SEQ ID NO: 2695 - protein, 9 aa, Homo Sapiens
ISFHVTLLD

SEQ ID NO: 2696 - protein, 9 aa, Homo Sapiens
FHVTLLDDS

SEQ ID NO: 2697 - protein, 9 aa, Homo Sapiens
HVTLLDDSN

SEQ ID NO: 2698 - protein, 9 aa, Homo Sapiens
FRVAPWIMT

SEQ ID NO: 2699 - protein, 9 aa, Homo Sapiens
ARKAGCKLT

SEQ ID NO: 2700 - protein, 9 aa, Homo Sapiens
NDRWIQDEM

SEQ ID NO: 2701 - protein, 9 aa, Homo Sapiens
IQDEMELGY

SEQ ID NO: 2702 - protein, 9 aa, Homo Sapiens
HKTLPVVFD

SEQ ID NO: 2703 - protein, 9 aa, Homo Sapiens
GPDFGYVTR

SEQ ID NO: 2704 - protein, 9 aa, Homo Sapiens
DSFGNLEVS

SEQ ID NO: 2705 - protein, 9 aa, Homo Sapiens
FGNLEVSPP

SEQ ID NO: 2706 - protein, 9 aa, Homo Sapiens
RRVTQVVRD

SEQ ID NO: 2707 - protein, 9 aa, Homo Sapiens
VELFVDWLA

SEQ ID NO: 2708 - protein, 9 aa, Homo Sapiens
DEFLSFVPA

SEQ ID NO: 2709 - protein, 9 aa, Homo Sapiens
EFLSFVPAP

SEQ ID NO: 2710 - protein, 9 aa, Homo Sapiens
ACFKLFQEK

SEQ ID NO: 2711 - protein, 9 aa, Homo Sapiens
KQKCGHGRA

SEQ ID NO: 2712 - protein, 9 aa, Homo Sapiens
GHGRALLFQ

SEQ ID NO: 2713 - protein, 9 aa, Homo Sapiens
GVVDDEQVK

SEQ ID NO: 2714 - protein, 9 aa, Homo Sapiens
INQVLSNKD

SEQ ID NO: 2715 - protein, 9 aa, Homo Sapiens
KDLINYNKF

SEQ ID NO: 2716 - protein, 9 aa, Homo Sapiens
INYNKFVQS

SEQ ID NO: 2717 - protein, 9 aa, Homo Sapiens
LFKTERKKA

SEQ ID NO: 2718 - protein, 9 aa, Homo Sapiens
FKTERKKAT

SEQ ID NO: 2719 - protein, 9 aa, Homo Sapiens
TAFFPDLVN

SEQ ID NO: 2720 - protein, 9 aa, Homo Sapiens
NGCCCLEEK

SEQ ID NO: 2721 - protein, 9 aa, Homo Sapiens
CCLEEKVRS

SEQ ID NO: 2722 - protein, 9 aa, Homo Sapiens
LGLHCTFID

SEQ ID NO: 2723 - protein, 9 aa, Homo Sapiens
IDDFTPYHM

SEQ ID NO: 2724 - protein, 9 aa, Homo Sapiens
EVHCGTNVC

SEQ ID NO: 2725 - protein, 9 aa, Homo Sapiens
YGSVPEGTE

SEQ ID NO: 2726 - protein, 9 aa, Homo Sapiens
TPGVDIYIS

SEQ ID NO: 2727 - protein, 9 aa, Homo Sapiens
TRRWRFDAT

SEQ ID NO: 2728 - protein, 9 aa, Homo Sapiens
FVDKRQWVW

SEQ ID NO: 2729 - protein, 9 aa, Homo Sapiens
VWGPSGYGG

SEQ ID NO: 2730 - protein, 9 aa, Homo Sapiens
HVHCLQDLE

SEQ ID NO: 2731 - protein, 9 aa, Homo Sapiens
DHKLVLHTS

SEQ ID NO: 2732 - protein, 9 aa, Homo Sapiens
HKLVLHTSS

SEQ ID NO: 2733 - protein, 9 aa, Homo Sapiens
SSYDAKRAQ

SEQ ID NO: 2734 - protein, 9 aa, Homo Sapiens
RAQVFHICG

SEQ ID NO: 2735 - protein, 9 aa, Homo Sapiens
QVFHICGPE

SEQ ID NO: 2736 - protein, 9 aa, Homo Sapiens
SFPDAGFTG

SEQ ID NO: 2737 - protein, 9 aa, Homo Sapiens
DDSNEDFSA

SEQ ID NO: 2738 - protein, 9 aa, Homo Sapiens
VFRVAPWIM

SEQ ID NO: 2739 - protein, 9 aa, Homo Sapiens
VAPWIMTPS

SEQ ID NO: 2740 - protein, 9 aa, Homo Sapiens
VYVCRVRNN

SEQ ID NO: 2741 - protein, 9 aa, Homo Sapiens
VDAVAELAR

SEQ ID NO: 2742 - protein, 9 aa, Homo Sapiens
AGCKLTICP

SEQ ID NO: 2743 - protein, 9 aa, Homo Sapiens
VQAPHKTLP

SEQ ID NO: 2744 - protein, 9 aa, Homo Sapiens
SPRNGELQD

SEQ ID NO: 2745 - protein, 9 aa, Homo Sapiens
KRILGPDFG

SEQ ID NO: 2746 - protein, 9 aa, Homo Sapiens
PDFGYVTRE

SEQ ID NO: 2747 - protein, 9 aa, Homo Sapiens
YVTREPRDR

SEQ ID NO: 2748 - protein, 9 aa, Homo Sapiens
IGGNLPGSS

SEQ ID NO: 2749 - protein, 9 aa, Homo Sapiens
GGNLPGSSG

SEQ ID NO: 2750 - protein, 9 aa, Homo Sapiens
GHVDEFLSF

SEQ ID NO: 2751 - protein, 9 aa, Homo Sapiens
LSFVPAPDG

SEQ ID NO: 2752 - protein, 9 aa, Homo Sapiens
SFVPAPDGK

SEQ ID NO: 2753 - protein, 9 aa, Homo Sapiens
VPAPDGKGF

SEQ ID NO: 2754 - protein, 9 aa, Homo Sapiens
GKGFRMLLA

SEQ ID NO: 2755 - protein, 9 aa, Homo Sapiens
HGRALLFQG

SEQ ID NO: 2756 - protein, 9 aa, Homo Sapiens
IDWNREVLK

SEQ ID NO: 2757 - protein, 9 aa, Homo Sapiens
WNREVLKRE

SEQ ID NO: 2758 - protein, 9 aa, Homo Sapiens
RELGLAECD

SEQ ID NO: 2759 - protein, 9 aa, Homo Sapiens
IPQLFKTER

SEQ ID NO: 2760 - protein, 9 aa, Homo Sapiens
PFGPIINGC

SEQ ID NO: 2761 - protein, 9 aa, Homo Sapiens
INGCCCLEE

SEQ ID NO: 2762 - protein, 9 aa, Homo Sapiens
FTPYHMLHG

SEQ ID NO: 2763 - protein, 9 aa, Homo Sapiens
VHCGTNVCR

SEQ ID NO: 2764 - protein, 9 aa, Homo Sapiens
GTNVCRKPF

SEQ ID NO: 2765 - protein, 9 aa, Homo Sapiens
PTSAVCVAG

SEQ ID NO: 2766 - protein, 9 aa, Homo Sapiens
EVYGTPGVD

SEQ ID NO: 2767 - protein, 9 aa, Homo Sapiens
RGRERADTR

SEQ ID NO: 2768 - protein, 9 aa, Homo Sapiens
RADTRRWRF

SEQ ID NO: 2769 - protein, 9 aa, Homo Sapiens
DKRQWVWGP

SEQ ID NO: 2770 - protein, 9 aa, Homo Sapiens
RQWVWGPSG

SEQ ID NO: 2771 - protein, 9 aa, Homo Sapiens
DVQDNCDQH

SEQ ID NO: 2772 - protein, 9 aa, Homo Sapiens
VHCLQDLED

SEQ ID NO: 2773 - protein, 9 aa, Homo Sapiens
QGPAALFDD

SEQ ID NO: 2774 - protein, 9 aa, Homo Sapiens
GPAALFDDH

SEQ ID NO: 2775 - protein, 9 aa, Homo Sapiens
PAALFDDHK

SEQ ID NO: 2776 - protein, 9 aa, Homo Sapiens
YDAKRAQVF

SEQ ID NO: 2777 - protein, 9 aa, Homo Sapiens
DAKRAQVFH

SEQ ID NO: 2778 - protein, 9 aa, Homo Sapiens
KRAQVFHIC

SEQ ID NO: 2779 - protein, 9 aa, Homo Sapiens
VFHICGPED

SEQ ID NO: 2780 - protein, 9 aa, Homo Sapiens
VSYEVPRLH

SEQ ID NO: 2781 - protein, 9 aa, Homo Sapiens
RFFVEGLSF

SEQ ID NO: 2782 - protein, 9 aa, Homo Sapiens
EVYVCRVRN

SEQ ID NO: 2783 - protein, 9 aa, Homo Sapiens
VCRVRNNTC

SEQ ID NO: 2784 - protein, 9 aa, Homo Sapiens
TCFVDAVAE

SEQ ID NO: 2785 - protein, 9 aa, Homo Sapiens
VAELARKAG

SEQ ID NO: 2786 - protein, 9 aa, Homo Sapiens
GCKLTICPQ

SEQ ID NO: 2787 - protein, 9 aa, Homo Sapiens
RNDRWIQDE

SEQ ID NO: 2788 - protein, 9 aa, Homo Sapiens
DEMELGYVQ

SEQ ID NO: 2789 - protein, 9 aa, Homo Sapiens
LGYVQAPHK

SEQ ID NO: 2790 - protein, 9 aa, Homo Sapiens
VFDSPRNGE

SEQ ID NO: 2791 - protein, 9 aa, Homo Sapiens
PRNGELQDF

SEQ ID NO: 2792 - protein, 9 aa, Homo Sapiens
GELQDFPYK

SEQ ID NO: 2793 - protein, 9 aa, Homo Sapiens
YKRILGPDF

SEQ ID NO: 2794 - protein, 9 aa, Homo Sapiens
SPPVVANGK

SEQ ID NO: 2795 - protein, 9 aa, Homo Sapiens
NGKEYPLGR

SEQ ID NO: 2796 - protein, 9 aa, Homo Sapiens
QPPVELFVD

SEQ ID NO: 2797 - protein, 9 aa, Homo Sapiens
PAPDGKGFR

SEQ ID NO: 2798 - protein, 9 aa, Homo Sapiens
LFQEKQKCG

SEQ ID NO: 2799 - protein, 9 aa, Homo Sapiens
KHLGIPKPF

SEQ ID NO: 2800 - protein, 9 aa, Homo Sapiens
EKVRSLLEP

SEQ ID NO: 2801 - protein, 9 aa, Homo Sapiens
EPLGLHCTF

SEQ ID NO: 2802 - protein, 9 aa, Homo Sapiens
HCGTNVCRK

SEQ ID NO: 2803 - protein, 9 aa, Homo Sapiens
CRKPFSFKW

SEQ ID NO: 2804 - protein, 9 aa, Homo Sapiens
ISPNMERGR

SEQ ID NO: 2805 - protein, 9 aa, Homo Sapiens
SPNMERGRE

SEQ ID NO: 2806 - protein, 9 aa, Homo Sapiens
MERGRERAD

SEQ ID NO: 2807 - protein, 9 aa, Homo Sapiens
ERGRERADT

SEQ ID NO: 2808 - protein, 9 aa, Homo Sapiens
NDLNDSHVQ

SEQ ID NO: 2809 - protein, 9 aa, Homo Sapiens
DSHVQISYH

SEQ ID NO: 2810 - protein, 9 aa, Homo Sapiens
SHVQISYHS

SEQ ID NO: 2811 - protein, 9 aa, Homo Sapiens
YHSSHEPLP

SEQ ID NO: 2812 - protein, 9 aa, Homo Sapiens
QWVWGPSGY

SEQ ID NO: 2813 - protein, 9 aa, Homo Sapiens
NCDRDDPSC

SEQ ID NO: 2814 - protein, 9 aa, Homo Sapiens
DPSCDVQDN

SEQ ID NO: 2815 - protein, 9 aa, Homo Sapiens
SCDVQDNCD

SEQ ID NO: 2816 - protein, 9 aa, Homo Sapiens
TQGPAALFD

SEQ ID NO: 2817 - protein, 9 aa, Homo Sapiens
CEAYRHVLG

SEQ ID NO: 2818 - protein, 9 aa, Homo Sapiens
YRHVLGQDK

SEQ ID NO: 2819 - protein, 9 aa, Homo Sapiens
SYEVPRLHG

SEQ ID NO: 2820 - protein, 9 aa, Homo Sapiens
VPRLHGDEE

SEQ ID NO: 2821 - protein, 9 aa, Homo Sapiens
PRLHGDEER

SEQ ID NO: 2822 - protein, 9 aa, Homo Sapiens
LHGDEERFF

SEQ ID NO: 2823 - protein, 9 aa, Homo Sapiens
DEERFFVEG

SEQ ID NO: 2824 - protein, 9 aa, Homo Sapiens
DAGFTGLIS

SEQ ID NO: 2825 - protein, 9 aa, Homo Sapiens
DSNEDFSAS

SEQ ID NO: 2826 - protein, 9 aa, Homo Sapiens
DFSASPIFT

SEQ ID NO: 2827 - protein, 9 aa, Homo Sapiens
TDTVVFRVA

SEQ ID NO: 2828 - protein, 9 aa, Homo Sapiens
PPLEVYVCR

SEQ ID NO: 2829 - protein, 9 aa, Homo Sapiens
ICPQAENRN

SEQ ID NO: 2830 - protein, 9 aa, Homo Sapiens
QAENRNDRW

SEQ ID NO: 2831 - protein, 9 aa, Homo Sapiens
LPVVFDSPR

SEQ ID NO: 2832 - protein, 9 aa, Homo Sapiens
RNGELQDFP

SEQ ID NO: 2833 - protein, 9 aa, Homo Sapiens
ANGKEYPLG

SEQ ID NO: 2834 - protein, 9 aa, Homo Sapiens
PGSSGRRVT

SEQ ID NO: 2835 - protein, 9 aa, Homo Sapiens
GRRVTQVVR

SEQ ID NO: 2836 - protein, 9 aa, Homo Sapiens
VRDFLHAQK

SEQ ID NO: 2837 - protein, 9 aa, Homo Sapiens
FRMLLASPG

SEQ ID NO: 2838 - protein, 9 aa, Homo Sapiens
CGHGRALLF

SEQ ID NO: 2839 - protein, 9 aa, Homo Sapiens
FQGVVDDEQ

SEQ ID NO: 2840 - protein, 9 aa, Homo Sapiens
QVKTISINQ

SEQ ID NO: 2841 - protein, 9 aa, Homo Sapiens
KKATAFFPD

SEQ ID NO: 2842 - protein, 9 aa, Homo Sapiens
GPIINGCCC

SEQ ID NO: 2843 - protein, 9 aa, Homo Sapiens
VRSLLEPLG

SEQ ID NO: 2844 - protein, 9 aa, Homo Sapiens
TFIDDFTPY

SEQ ID NO: 2845 - protein, 9 aa, Homo Sapiens
YHMLHGEVH

SEQ ID NO: 2846 - protein, 9 aa, Homo Sapiens
KPFSFKWWN

SEQ ID NO: 2847 - protein, 9 aa, Homo Sapiens
VPEGTEMFE

SEQ ID NO: 2848 - protein, 9 aa, Homo Sapiens
PNMERGRER

SEQ ID NO: 2849 - protein, 9 aa, Homo Sapiens
RERADTRRW

SEQ ID NO: 2850 - protein, 9 aa, Homo Sapiens
MNSPSNDLN

SEQ ID NO: 2851 - protein, 9 aa, Homo Sapiens
PSNDLNDSH

SEQ ID NO: 2852 - protein, 9 aa, Homo Sapiens
NDSHVQISY

SEQ ID NO: 2853 - protein, 9 aa, Homo Sapiens
TCVDISLDC

SEQ ID NO: 2854 - protein, 9 aa, Homo Sapiens
CDLNCEGRQ

SEQ ID NO: 2855 - protein, 9 aa, Homo Sapiens
GRQDRNFVD

SEQ ID NO: 2856 - protein, 9 aa, Homo Sapiens
RQDRNFVDK

SEQ ID NO: 2857 - protein, 9 aa, Homo Sapiens
VDKRQWVWG

SEQ ID NO: 2858 - protein, 9 aa, Homo Sapiens
VNCDRDDPS

SEQ ID NO: 2859 - protein, 9 aa, Homo Sapiens
RDDPSCDVQ

SEQ ID NO: 2860 - protein, 9 aa, Homo Sapiens
QDNCDQHVH

SEQ ID NO: 2861 - protein, 9 aa, Homo Sapiens
DNCDQHVHC

SEQ ID NO: 2862 - protein, 9 aa, Homo Sapiens
LHTSSYDAK

SEQ ID NO: 2863 - protein, 9 aa, Homo Sapiens
TSSYDAKRA

SEQ ID NO: 2864 - protein, 9 aa, Homo Sapiens
GPEDVCEAY

SEQ ID NO: 2865 - protein, 9 aa, Homo Sapiens
DKVSYEVPR

SEQ ID NO: 2866 - protein, 9 aa, Homo Sapiens
EVPRLHGDE

SEQ ID NO: 2867 - protein, 9 aa, Homo Sapiens
GDEERFFVE

SEQ ID NO: 2868 - protein, 9 aa, Homo Sapiens
LDDSNEDFS

SEQ ID NO: 2869 - protein, 9 aa, Homo Sapiens
TPSTLPPLE

SEQ ID NO: 2870 - protein, 9 aa, Homo Sapiens
VRNNTCFVD

SEQ ID NO: 2871 - protein, 9 aa, Homo Sapiens
PQAENRNDR

SEQ ID NO: 2872 - protein, 9 aa, Homo Sapiens
NRNDRWIQD

SEQ ID NO: 2873 - protein, 9 aa, Homo Sapiens
DFGYVTREP

SEQ ID NO: 2874 - protein, 9 aa, Homo Sapiens
FGYVTREPR

SEQ ID NO: 2875 - protein, 9 aa, Homo Sapiens
GYVTREPRD

SEQ ID NO: 2876 - protein, 9 aa, Homo Sapiens
EPRDRSVSG

SEQ ID NO: 2877 - protein, 9 aa, Homo Sapiens
VSGLDSFGN

SEQ ID NO: 2878 - protein, 9 aa, Homo Sapiens
PVVANGKEY

SEQ ID NO: 2879 - protein, 9 aa, Homo Sapiens
AQKVQPPVE

SEQ ID NO: 2880 - protein, 9 aa, Homo Sapiens
PPVELFVDW

SEQ ID NO: 2881 - protein, 9 aa, Homo Sapiens
DWLAVGHVD

SEQ ID NO: 2882 - protein, 9 aa, Homo Sapiens
CFKLFQEKQ

SEQ ID NO: 2883 - protein, 9 aa, Homo Sapiens
TERKKATAF

SEQ ID NO: 2884 - protein, 9 aa, Homo Sapiens
LGKHLGIPK

SEQ ID NO: 2885 - protein, 9 aa, Homo Sapiens
HCTFIDDFT

SEQ ID NO: 2886 - protein, 9 aa, Homo Sapiens
VCRKPFSFK

SEQ ID NO: 2887 - protein, 9 aa, Homo Sapiens
ADTRRWRFD

SEQ ID NO: 2888 - protein, 9 aa, Homo Sapiens
NSPSNDLND

SEQ ID NO: 2889 - protein, 9 aa, Homo Sapiens
NCEGRQDRN

SEQ ID NO: 2890 - protein, 9 aa, Homo Sapiens
RNFVDKRQW

SEQ ID NO: 2891 - protein, 9 aa, Homo Sapiens
KRQWVWGPS

SEQ ID NO: 2892 - protein, 9 aa, Homo Sapiens
CDRDDPSCD

SEQ ID NO: 2893 - protein, 9 aa, Homo Sapiens
DDPSCDVQD

SEQ ID NO: 2894 - protein, 9 aa, Homo Sapiens
EGLSFPDAG

SEQ ID NO: 2895 - protein, 9 aa, Homo Sapiens
LEVYVCRVR

SEQ ID NO: 2896 - protein, 9 aa, Homo Sapiens
PVVFDSPRN

SEQ ID NO: 2897 - protein, 9 aa, Homo Sapiens
VGHVDEFLS

SEQ ID NO: 2898 - protein, 9 aa, Homo Sapiens
SPGACFKLF

SEQ ID NO: 2899 - protein, 9 aa, Homo Sapiens
PGACFKLFQ

SEQ ID NO: 2900 - protein, 9 aa, Homo Sapiens
FKLFQEKQK

SEQ ID NO: 2901 - protein, 9 aa, Homo Sapiens
FQEKQKCGH

SEQ ID NO: 2902 - protein, 9 aa, Homo Sapiens
EQVKTISIN

SEQ ID NO: 2903 - protein, 9 aa, Homo Sapiens
NKDLINYNK

SEQ ID NO: 2904 - protein, 9 aa, Homo Sapiens
NKFVQSCID

SEQ ID NO: 2905 - protein, 9 aa, Homo Sapiens
KFVQSCIDW

SEQ ID NO: 2906 - protein, 9 aa, Homo Sapiens
VQSCIDWNR

SEQ ID NO: 2907 - protein, 9 aa, Homo Sapiens
QSCIDWNRE

SEQ ID NO: 2908 - protein, 9 aa, Homo Sapiens
REVLKRELG

SEQ ID NO: 2909 - protein, 9 aa, Homo Sapiens
PQLFKTERK

SEQ ID NO: 2910 - protein, 9 aa, Homo Sapiens
FGPIINGCC

SEQ ID NO: 2911 - protein, 9 aa, Homo Sapiens
DFTPYHMLH

SEQ ID NO: 2912 - protein, 9 aa, Homo Sapiens
HGEVHCGTN

SEQ ID NO: 2913 - protein, 9 aa, Homo Sapiens
CGTNVCRKP

SEQ ID NO: 2914 - protein, 9 aa, Homo Sapiens
TNVCRKPFS

SEQ ID NO: 2915 - protein, 9 aa, Homo Sapiens
PFSFKWWNM

SEQ ID NO: 2916 - protein, 9 aa, Homo Sapiens
SFKWWNMVP

SEQ ID NO: 2917 - protein, 9 aa, Homo Sapiens
RWRFDATLE

SEQ ID NO: 2918 - protein, 9 aa, Homo Sapiens
PEDVCEAYR

SEQ ID NO: 2919 - protein, 9 aa, Homo Sapiens
QDKVSYEVP

SEQ ID NO: 2920 - protein, 9 aa, Homo Sapiens
EDFSASPIF

SEQ ID NO: 2921 - protein, 9 aa, Homo Sapiens
PHKTLPVVF

SEQ ID NO: 2922 - protein, 9 aa, Homo Sapiens
DSPRNGELQ

SEQ ID NO: 2923 - protein, 9 aa, Homo Sapiens
NGELQDFPY

SEQ ID NO: 2924 - protein, 9 aa, Homo Sapiens
DFPYKRILG

SEQ ID NO: 2925 - protein, 9 aa, Homo Sapiens
PPVVANGKE

SEQ ID NO: 2926 - protein, 9 aa, Homo Sapiens
EKQKCGHGR

SEQ ID NO: 2927 - protein, 9 aa, Homo Sapiens
RKKATAFFP

SEQ ID NO: 2928 - protein, 9 aa, Homo Sapiens
CCCLEEKVR

SEQ ID NO: 2929 - protein, 9 aa, Homo Sapiens
EGTEMFEVY

SEQ ID NO: 2930 - protein, 9 aa, Homo Sapiens
DRNFVDKRQ

SEQ ID NO: 2931 - protein, 9 aa, Homo Sapiens
PSCDVQDNC

SEQ ID NO: 2932 - protein, 9 aa, Homo Sapiens
EDVCEAYRH

SEQ ID NO: 2933 - protein, 9 aa, Homo Sapiens
DDEQVKTIS

SEQ ID NO: 2934 - protein, 9 aa, Homo Sapiens
PKPFGPIIN

SEQ ID NO: 2935 - protein, 9 aa, Homo Sapiens
RKPFSFKWW

SEQ ID NO: 2936 - protein, 9 aa, Homo Sapiens
ERFFVEGLS

SEQ ID NO: 2937 - protein, 9 aa, Homo Sapiens
ENRNDRWIQ

SEQ ID NO: 2938 - protein, 9 aa, Homo Sapiens
ECDIIDIPQ

SEQ ID NO: 2939 - protein, 9 aa, Homo Sapiens
EEKVRSLLE

SEQ ID NO: 2940 - protein, 9 aa, Homo Sapiens
TLAPLEVYV

SEQ ID NO: 2941 - protein, 9 aa, Homo Sapiens
MTPSTLAPL

SEQ ID NO: 2942 - protein, 9 aa, Homo Sapiens
IMTPSTLAP

SEQ ID NO: 2943 - protein, 9 aa, Homo Sapiens
WIMTPSTLA

SEQ ID NO: 2944 - protein, 9 aa, Homo Sapiens
STLAPLEVY

SEQ ID NO: 2945 - protein, 9 aa, Homo Sapiens
LAPLEVYVC

SEQ ID NO: 2946 - protein, 9 aa, Homo Sapiens
PSTLAPLEV

SEQ ID NO: 2947 - protein, 9 aa, Homo Sapiens
APLEVYVCR

SEQ ID NO: 2948 - protein, 9 aa, Homo Sapiens
TPSTLAPLE

SEQ ID NO: 2949 - protein, 9 aa, Homo Sapiens
DEFLSFVPV

SEQ ID NO: 2950 - protein, 9 aa, Homo Sapiens
FLSFVPVPD

SEQ ID NO: 2951 - protein, 9 aa, Homo Sapiens
LSFVPVPDG

SEQ ID NO: 2952 - protein, 9 aa, Homo Sapiens
FVPVPDGKG

SEQ ID NO: 2953 - protein, 9 aa, Homo Sapiens
VPDGKGFRM

SEQ ID NO: 2954 - protein, 9 aa, Homo Sapiens
EFLSFVPVP

SEQ ID NO: 2955 - protein, 9 aa, Homo Sapiens
SFVPVPDGK

SEQ ID NO: 2956 - protein, 9 aa, Homo Sapiens
PVPDGKGFR

SEQ ID NO: 2957 - protein, 9 aa, Homo Sapiens
VPVPDGKGF

SEQ ID NO: 2958 - protein, 9 aa, Homo Sapiens
ELARKAGCK

SEQ ID NO: 2959 - protein, 9 aa, Homo Sapiens
ALLFQGVVD

SEQ ID NO: 2960 - protein, 9 aa, Homo Sapiens
KLVLHTSSY

SEQ ID NO: 2961 - protein, 9 aa, Homo Sapiens
GVVDDEQVK

SEQ ID NO: 2962 - protein, 9 aa, Homo Sapiens
IIDIPQLFK

SEQ ID NO: 2963 - protein, 9 aa, Homo Sapiens
RIVRVSLEH

SEQ ID NO: 2964 - protein, 9 aa, Homo Sapiens
RVAPWIMTP

SEQ ID NO: 2965 - protein, 9 aa, Homo Sapiens
SINQVLSNK

SEQ ID NO: 2966 - protein, 9 aa, Homo Sapiens
LVNMLVLGK

SEQ ID NO: 2967 - protein, 9 aa, Homo Sapiens
EVYGTPGVD

SEQ ID NO: 2968 - protein, 9 aa, Homo Sapiens
VLGQDKVSY

SEQ ID NO: 2969 - protein, 9 aa, Homo Sapiens
RILGPDFGY

SEQ ID NO: 2970 - protein, 9 aa, Homo Sapiens
ILIGGNLPG

SEQ ID NO: 2971 - protein, 9 aa, Homo Sapiens
QLFKTERKK

SEQ ID NO: 2972 - protein, 9 aa, Homo Sapiens
LVDIYGSVP

SEQ ID NO: 2973 - protein, 9 aa, Homo Sapiens
RGRERADTR

SEQ ID NO: 2974 - protein, 9 aa, Homo Sapiens
RQDRNFVDK

SEQ ID NO: 2975 - protein, 9 aa, Homo Sapiens
GLISFHVTL

SEQ ID NO: 2976 - protein, 9 aa, Homo Sapiens
PVVANGKEY

SEQ ID NO: 2977 - protein, 9 aa, Homo Sapiens
FVDWLAVGH

SEQ ID NO: 2978 - protein, 9 aa, Homo Sapiens
LLASPGACF

SEQ ID NO: 2979 - protein, 9 aa, Homo Sapiens
NVCRKPFSF

SEQ ID NO: 2980 - protein, 9 aa, Homo Sapiens
AVCVAGVET

SEQ ID NO: 2981 - protein, 9 aa, Homo Sapiens
RLHGDEERF

SEQ ID NO: 2982 - protein, 9 aa, Homo Sapiens
PIFTDTVVF

SEQ ID NO: 2983 - protein, 9 aa, Homo Sapiens
RILIGGNLP

SEQ ID NO: 2984 - protein, 9 aa, Homo Sapiens
KVQPPVELF

SEQ ID NO: 2985 - protein, 9 aa, Homo Sapiens
RVSLEHPTS

SEQ ID NO: 2986 - protein, 9 aa, Homo Sapiens
SVPEGTEMF

SEQ ID NO: 2987 - protein, 9 aa, Homo Sapiens
AVLYLTCVD

SEQ ID NO: 2988 - protein, 9 aa, Homo Sapiens
VLYLTCVDI

SEQ ID NO: 2989 - protein, 9 aa, Homo Sapiens
EVYVCRVRN

SEQ ID NO: 2990 - protein, 9 aa, Homo Sapiens
RVTQVVRDF

SEQ ID NO: 2991 - protein, 9 aa, Homo Sapiens
FLHAQKVQP

SEQ ID NO: 2992 - protein, 9 aa, Homo Sapiens
IDWNREVLK

SEQ ID NO: 2993 - protein, 9 aa, Homo Sapiens
SLLEPLGLH

SEQ ID NO: 2994 - protein, 9 aa, Homo Sapiens
LLEPLGLHC

SEQ ID NO: 2995 - protein, 9 aa, Homo Sapiens
SLQRIVRVS

SEQ ID NO: 2996 - protein, 9 aa, Homo Sapiens
DLNDSHVQI

SEQ ID NO: 2997 - protein, 9 aa, Homo Sapiens
PLPLAYAVL

SEQ ID NO: 2998 - protein, 9 aa, Homo Sapiens
DVQDNCDQH

SEQ ID NO: 2999 - protein, 9 aa, Homo Sapiens
HVLGQDKVS

SEQ ID NO: 3000 - protein, 9 aa, Homo Sapiens
VVFRVAPWI

SEQ ID NO: 3001 - protein, 9 aa, Homo Sapiens
RVRNNTCFV

SEQ ID NO: 3002 - protein, 9 aa, Homo Sapiens
AVAELARKA

SEQ ID NO: 3003 - protein, 9 aa, Homo Sapiens
TICPQAENR

SEQ ID NO: 3004 - protein, 9 aa, Homo Sapiens
ELGYVQAPH

SEQ ID NO: 3005 - protein, 9 aa, Homo Sapiens
YVTREPRDR

SEQ ID NO: 3006 - protein, 9 aa, Homo Sapiens
EVSPPVVAN

SEQ ID NO: 3007 - protein, 9 aa, Homo Sapiens
QVVRDFLHA

SEQ ID NO: 3008 - protein, 9 aa, Homo Sapiens
LASPGACFK

SEQ ID NO: 3009 - protein, 9 aa, Homo Sapiens
LVLGKHLGI

SEQ ID NO: 3010 - protein, 9 aa, Homo Sapiens
LPLAYAVLY

SEQ ID NO: 3011 - protein, 9 aa, Homo Sapiens
VLRTQGPAA

SEQ ID NO: 3012 - protein, 9 aa, Homo Sapiens
GLSFPDAGF

SEQ ID NO: 3013 - protein, 9 aa, Homo Sapiens
TLPPLEVYV

SEQ ID NO: 3014 - protein, 9 aa, Homo Sapiens
LGYVQAPHK

SEQ ID NO: 3015 - protein, 9 aa, Homo Sapiens
NLPGSSGRR

SEQ ID NO: 3016 - protein, 9 aa, Homo Sapiens
WLAVGHVDE

SEQ ID NO: 3017 - protein, 9 aa, Homo Sapiens
MLLASPGAC

SEQ ID NO: 3018 - protein, 9 aa, Homo Sapiens
EVLKRELGL

SEQ ID NO: 3019 - protein, 9 aa, Homo Sapiens
DIIDIPQLF

SEQ ID NO: 3020 - protein, 9 aa, Homo Sapiens
GVETLVDIY

SEQ ID NO: 3021 - protein, 9 aa, Homo Sapiens
TLEIIVVMN

SEQ ID NO: 3022 - protein, 9 aa, Homo Sapiens
DLNCEGRQD

SEQ ID NO: 3023 - protein, 9 aa, Homo Sapiens
FVDKRQWVW

SEQ ID NO: 3024 - protein, 9 aa, Homo Sapiens
GILLVNCDR

SEQ ID NO: 3025 - protein, 9 aa, Homo Sapiens
DLEDMSVMV

SEQ ID NO: 3026 - protein, 9 aa, Homo Sapiens
SVMVLRTQG

SEQ ID NO: 3027 - protein, 9 aa, Homo Sapiens
MVLRTQGPA

SEQ ID NO: 3028 - protein, 9 aa, Homo Sapiens
RTQGPAALF

SEQ ID NO: 3029 - protein, 9 aa, Homo Sapiens
RFFVEGLSF

SEQ ID NO: 3030 - protein, 9 aa, Homo Sapiens
STLPPLEVY

SEQ ID NO: 3031 - protein, 9 aa, Homo Sapiens
FVDAVAELA

SEQ ID NO: 3032 - protein, 9 aa, Homo Sapiens
KLTICPQAE

SEQ ID NO: 3033 - protein, 9 aa, Homo Sapiens
YVQAPHKTL

SEQ ID NO: 3034 - protein, 9 aa, Homo Sapiens
ELQDFPYKR

SEQ ID NO: 3035 - protein, 9 aa, Homo Sapiens
ILGPDFGYV

SEQ ID NO: 3036 - protein, 9 aa, Homo Sapiens
SVSGLDSFG

SEQ ID NO: 3037 - protein, 9 aa, Homo Sapiens
VRDFLHAQK

SEQ ID NO: 3038 - protein, 9 aa, Homo Sapiens
LLFQGVVDD

SEQ ID NO: 3039 - protein, 9 aa, Homo Sapiens
KVRSLLEPL

SEQ ID NO: 3040 - protein, 9 aa, Homo Sapiens
EVHCGTNVC

SEQ ID NO: 3041 - protein, 9 aa, Homo Sapiens
VCRKPFSFK

SEQ ID NO: 3042 - protein, 9 aa, Homo Sapiens
IVRVSLEHP

SEQ ID NO: 3043 - protein, 9 aa, Homo Sapiens
SLEHPTSAV

SEQ ID NO: 3044 - protein, 9 aa, Homo Sapiens
CVAGVETLV

SEQ ID NO: 3045 - protein, 9 aa, Homo Sapiens
DIYISPNME

SEQ ID NO: 3046 - protein, 9 aa, Homo Sapiens
VVMNSPSND

SEQ ID NO: 3047 - protein, 9 aa, Homo Sapiens
SHEPLPLAY

SEQ ID NO: 3048 - protein, 9 aa, Homo Sapiens
LVLHTSSYD

SEQ ID NO: 3049 - protein, 9 aa, Homo Sapiens
LLDDSNEDF

SEQ ID NO: 3050 - protein, 9 aa, Homo Sapiens
TVVFRVAPW

SEQ ID NO: 3051 - protein, 9 aa, Homo Sapiens
YVCRVRNNT

SEQ ID NO: 3052 - protein, 9 aa, Homo Sapiens
DAVAELARK

SEQ ID NO: 3053 - protein, 9 aa, Homo Sapiens
REPRDRSVS

SEQ ID NO: 3054 - protein, 9 aa, Homo Sapiens
NLEVSPPVV

SEQ ID NO: 3055 - protein, 9 aa, Homo Sapiens
SPPVVANGK

SEQ ID NO: 3056 - protein, 9 aa, Homo Sapiens
GRRVTQVVR

SEQ ID NO: 3057 - protein, 9 aa, Homo Sapiens
VVRDFLHAQ

SEQ ID NO: 3058 - protein, 9 aa, Homo Sapiens
FLSFVPAPD

SEQ ID NO: 3059 - protein, 9 aa, Homo Sapiens
SFVPAPDGK

SEQ ID NO: 3060 - protein, 9 aa, Homo Sapiens
FKLFQEKQK

SEQ ID NO: 3061 - protein, 9 aa, Homo Sapiens
VVDDEQVKT

SEQ ID NO: 3062 - protein, 9 aa, Homo Sapiens
VLSNKDLIN

SEQ ID NO: 3063 - protein, 9 aa, Homo Sapiens
INYNKFVQS

SEQ ID NO: 3064 - protein, 9 aa, Homo Sapiens
VLKRELGLA

SEQ ID NO: 3065 - protein, 9 aa, Homo Sapiens
DLVNMLVLG

SEQ ID NO: 3066 - protein, 9 aa, Homo Sapiens
TLVDIYGSV

SEQ ID NO: 3067 - protein, 9 aa, Homo Sapiens
DIYGSVPEG

SEQ ID NO: 3068 - protein, 9 aa, Homo Sapiens
GVDIYISPN

SEQ ID NO: 3069 - protein, 9 aa, Homo Sapiens
RRWRFDATL

SEQ ID NO: 3070 - protein, 9 aa, Homo Sapiens
ATLEIIVVM

SEQ ID NO: 3071 - protein, 9 aa, Homo Sapiens
EIIVVMNSP

SEQ ID NO: 3072 - protein, 9 aa, Homo Sapiens
IVVMNSPSN

SEQ ID NO: 3073 - protein, 9 aa, Homo Sapiens
PLAYAVLYL

SEQ ID NO: 3074 - protein, 9 aa, Homo Sapiens
QWVWGPSGY

SEQ ID NO: 3075 - protein, 9 aa, Homo Sapiens
ILLVNCDRD

SEQ ID NO: 3076 - protein, 9 aa, Homo Sapiens
ALFDDHKLV

SEQ ID NO: 3077 - protein, 9 aa, Homo Sapiens
YDAKRAQVF

SEQ ID NO: 3078 - protein, 9 aa, Homo Sapiens
HICGPEDVC

SEQ ID NO: 3079 - protein, 9 aa, Homo Sapiens
EVPRLHGDE

SEQ ID NO: 3080 - protein, 9 aa, Homo Sapiens
RKAGCKLTI

SEQ ID NO: 3081 - protein, 9 aa, Homo Sapiens
PHKTLPVVF

SEQ ID NO: 3082 - protein, 9 aa, Homo Sapiens
GPDFGYVTR

SEQ ID NO: 3083 - protein, 9 aa, Homo Sapiens
VVANGKEYP

SEQ ID NO: 3084 - protein, 9 aa, Homo Sapiens
GNLPGSSGR

SEQ ID NO: 3085 - protein, 9 aa, Homo Sapiens
ELFVDWLAV

SEQ ID NO: 3086 - protein, 9 aa, Homo Sapiens
AVGHVDEFL

SEQ ID NO: 3087 - protein, 9 aa, Homo Sapiens
HVDEFLSFV

SEQ ID NO: 3088 - protein, 9 aa, Homo Sapiens
CGHGRALLF

SEQ ID NO: 3089 - protein, 9 aa, Homo Sapiens
QVLSNKDLI

SEQ ID NO: 3090 - protein, 9 aa, Homo Sapiens
DLINYNKFV

SEQ ID NO: 3091 - protein, 9 aa, Homo Sapiens
KTERKKATA

SEQ ID NO: 3092 - protein, 9 aa, Homo Sapiens
LGKHLGIPK

SEQ ID NO: 3093 - protein, 9 aa, Homo Sapiens
PIINGCCCL

SEQ ID NO: 3094 - protein, 9 aa, Homo Sapiens
CLEEKVRSL

SEQ ID NO: 3095 - protein, 9 aa, Homo Sapiens
IIVVMNSPS

SEQ ID NO: 3096 - protein, 9 aa, Homo Sapiens
HVQISYHSS

SEQ ID NO: 3097 - protein, 9 aa, Homo Sapiens
QISYHSSHE

SEQ ID NO: 3098 - protein, 9 aa, Homo Sapiens
YLTCVDISL

SEQ ID NO: 3099 - protein, 9 aa, Homo Sapiens
WVWGPSGYG

SEQ ID NO: 3100 - protein, 9 aa, Homo Sapiens
QVFHICGPE

SEQ ID NO: 3101 - protein, 9 aa, Homo Sapiens
YRHVLGQDK

SEQ ID NO: 3102 - protein, 9 aa, Homo Sapiens
KVSYEVPRL

SEQ ID NO: 3103 - protein, 9 aa, Homo Sapiens
HVTLLDDSN

SEQ ID NO: 3104 - protein, 9 aa, Homo Sapiens
TLLDDSNED

SEQ ID NO: 3105 - protein, 9 aa, Homo Sapiens
TLPVVFDSP

SEQ ID NO: 3106 - protein, 9 aa, Homo Sapiens
SPRNGELQD

SEQ ID NO: 3107 - protein, 9 aa, Homo Sapiens
GLDSFGNLE

SEQ ID NO: 3108 - protein, 9 aa, Homo Sapiens
KEYPLGRIL

SEQ ID NO: 3109 - protein, 9 aa, Homo Sapiens
PLGRILIGG

SEQ ID NO: 3110 - protein, 9 aa, Homo Sapiens
GSSGRRVTQ

SEQ ID NO: 3111 - protein, 9 aa, Homo Sapiens
FVPAPDGKG

SEQ ID NO: 3112 - protein, 9 aa, Homo Sapiens
ACFKLFQEK

SEQ ID NO: 3113 - protein, 9 aa, Homo Sapiens
KLFQEKQKC

SEQ ID NO: 3114 - protein, 9 aa, Homo Sapiens
QVKTISINQ

SEQ ID NO: 3115 - protein, 9 aa, Homo Sapiens
TISINQVLS

SEQ ID NO: 3116 - protein, 9 aa, Homo Sapiens
CIDWNREVL

SEQ ID NO: 3117 - protein, 9 aa, Homo Sapiens
PQLFKTERK

SEQ ID NO: 3118 - protein, 9 aa, Homo Sapiens
TERKKATAF

SEQ ID NO: 3119 - protein, 9 aa, Homo Sapiens
MLVLGKHLG

SEQ ID NO: 3120 - protein, 9 aa, Homo Sapiens
FIDDFTPYH

SEQ ID NO: 3121 - protein, 9 aa, Homo Sapiens
LQRIVRVSL

SEQ ID NO: 3122 - protein, 9 aa, Homo Sapiens
VQISYHSSH

SEQ ID NO: 3123 - protein, 9 aa, Homo Sapiens
SGYGGILLV

SEQ ID NO: 3124 - protein, 9 aa, Homo Sapiens
CLQDLEDMS

SEQ ID NO: 3125 - protein, 9 aa, Homo Sapiens
QDLEDMSVM

SEQ ID NO: 3126 - protein, 9 aa, Homo Sapiens
PAALFDDHK

SEQ ID NO: 3127 - protein, 9 aa, Homo Sapiens
DAKRAQVFH

SEQ ID NO: 3128 - protein, 9 aa, Homo Sapiens
FVEGLSFPD

SEQ ID NO: 3129 - protein, 9 aa, Homo Sapiens
PPLEVYVCR

SEQ ID NO: 3130 - protein, 9 aa, Homo Sapiens
AELARKAGC

SEQ ID NO: 3131 - protein, 9 aa, Homo Sapiens
IQDEMELGY

SEQ ID NO: 3132 - protein, 9 aa, Homo Sapiens
VVFDSPRNG

SEQ ID NO: 3133 - protein, 9 aa, Homo Sapiens
GELQDFPYK

SEQ ID NO: 3134 - protein, 9 aa, Homo Sapiens
EPRDRSVSG

SEQ ID NO: 3135 - protein, 9 aa, Homo Sapiens
RSVSGLDSF

SEQ ID NO: 3136 - protein, 9 aa, Homo Sapiens
SGRRVTQVV

SEQ ID NO: 3137 - protein, 9 aa, Homo Sapiens
PVELFVDWL

SEQ ID NO: 3138 - protein, 9 aa, Homo Sapiens
DWLAVGHVD

SEQ ID NO: 3139 - protein, 9 aa, Homo Sapiens
RALLFQGVV

SEQ ID NO: 3140 - protein, 9 aa, Homo Sapiens
LINYNKFVQ

SEQ ID NO: 3141 - protein, 9 aa, Homo Sapiens
GLAECDIID

SEQ ID NO: 3142 - protein, 9 aa, Homo Sapiens
DIPQLFKTE

SEQ ID NO: 3143 - protein, 9 aa, Homo Sapiens
KHLGIPKPF

SEQ ID NO: 3144 - protein, 9 aa, Homo Sapiens
IINGCCCLE

SEQ ID NO: 3145 - protein, 9 aa, Homo Sapiens
EPLGLHCTF

SEQ ID NO: 3146 - protein, 9 aa, Homo Sapiens
PLGLHCTFI

SEQ ID NO: 3147 - protein, 9 aa, Homo Sapiens
YHMLHGEVH

SEQ ID NO: 3148 - protein, 9 aa, Homo Sapiens
MLHGEVHCG

SEQ ID NO: 3149 - protein, 9 aa, Homo Sapiens
EGTEMFEVY

SEQ ID NO: 3150 - protein, 9 aa, Homo Sapiens
YGTPGVDIY

SEQ ID NO: 3151 - protein, 9 aa, Homo Sapiens
YISPNMERG

SEQ ID NO: 3152 - protein, 9 aa, Homo Sapiens
RADTRRWRF

SEQ ID NO: 3153 - protein, 9 aa, Homo Sapiens
RWRFDATLE

SEQ ID NO: 3154 - protein, 9 aa, Homo Sapiens
AYAVLYLTC

SEQ ID NO: 3155 - protein, 9 aa, Homo Sapiens
CVDISLDCD

SEQ ID NO: 3156 - protein, 9 aa, Homo Sapiens
SLDCDLNCE

SEQ ID NO: 3157 - protein, 9 aa, Homo Sapiens
LLVNCDRDD

SEQ ID NO: 3158 - protein, 9 aa, Homo Sapiens
LVNCDRDDP

SEQ ID NO: 3159 - protein, 9 aa, Homo Sapiens
RDDPSCDVQ

SEQ ID NO: 3160 - protein, 9 aa, Homo Sapiens
LHTSSYDAK

SEQ ID NO: 3161 - protein, 9 aa, Homo Sapiens
SYDAKRAQV

SEQ ID NO: 3162 - protein, 9 aa, Homo Sapiens
DVCEAYRHV

SEQ ID NO: 3163 - protein, 9 aa, Homo Sapiens
AYRHVLGQD

SEQ ID NO: 3164 - protein, 9 aa, Homo Sapiens
VSYEVPRLH

SEQ ID NO: 3165 - protein, 9 aa, Homo Sapiens
AGFTGLISF

SEQ ID NO: 3166 - protein, 9 aa, Homo Sapiens
IFTDTVVFR

SEQ ID NO: 3167 - protein, 9 aa, Homo Sapiens
PWIMTPSTL

SEQ ID NO: 3168 - protein, 9 aa, Homo Sapiens
YKRILGPDF

SEQ ID NO: 3169 - protein, 9 aa, Homo Sapiens
VPAPDGKGF

SEQ ID NO: 3170 - protein, 9 aa, Homo Sapiens
ISINQVLSN

SEQ ID NO: 3171 - protein, 9 aa, Homo Sapiens
NKDLINYNK

SEQ ID NO: 3172 - protein, 9 aa, Homo Sapiens
FVQSCIDWN

SEQ ID NO: 3173 - protein, 9 aa, Homo Sapiens
LKRELGLAE

SEQ ID NO: 3174 - protein, 9 aa, Homo Sapiens
RELGLAECD

SEQ ID NO: 3175 - protein, 9 aa, Homo Sapiens
ELGLAECDI

SEQ ID NO: 3176 - protein, 9 aa, Homo Sapiens
VLGKHLGIP

SEQ ID NO: 3177 - protein, 9 aa, Homo Sapiens
HLGIPKPFG

SEQ ID NO: 3178 - protein, 9 aa, Homo Sapiens
RSLLEPLGL

SEQ ID NO: 3179 - protein, 9 aa, Homo Sapiens
TFIDDFTPY

SEQ ID NO: 3180 - protein, 9 aa, Homo Sapiens
QRIVRVSLE

SEQ ID NO: 3181 - protein, 9 aa, Homo Sapiens
LEHPTSAVC

SEQ ID NO: 3182 - protein, 9 aa, Homo Sapiens
SAVCVAGVE

SEQ ID NO: 3183 - protein, 9 aa, Homo Sapiens
IYISPNMER

SEQ ID NO: 3184 - protein, 9 aa, Homo Sapiens
PNMERGRER

SEQ ID NO: 3185 - protein, 9 aa, Homo Sapiens
QDRNFVDKR

SEQ ID NO: 3186 - protein, 9 aa, Homo Sapiens
QDNCDQHVH

SEQ ID NO: 3187 - protein, 9 aa, Homo Sapiens
HVHCLQDLE

SEQ ID NO: 3188 - protein, 9 aa, Homo Sapiens
VLHTSSYDA

SEQ ID NO: 3189 - protein, 9 aa, Homo Sapiens
EAYRHVLGQ

SEQ ID NO: 3190 - protein, 9 aa, Homo Sapiens
PLEVYVCRV

SEQ ID NO: 3191 - protein, 9 aa, Homo Sapiens
EMELGYVQA

SEQ ID NO: 3192 - protein, 9 aa, Homo Sapiens
PVVFDSPRN

SEQ ID NO: 3193 - protein, 9 aa, Homo Sapiens
KRILGPDFG

SEQ ID NO: 3194 - protein, 9 aa, Homo Sapiens
NGKEYPLGR

SEQ ID NO: 3195 - protein, 9 aa, Homo Sapiens
LIGGNLPGS

SEQ ID NO: 3196 - protein, 9 aa, Homo Sapiens
SSGRRVTQV

SEQ ID NO: 3197 - protein, 9 aa, Homo Sapiens
GHVDEFLSF

SEQ ID NO: 3198 - protein, 9 aa, Homo Sapiens
KGFRMLLAS

SEQ ID NO: 3199 - protein, 9 aa, Homo Sapiens
KTISINQVL

SEQ ID NO: 3200 - protein, 9 aa, Homo Sapiens
KDLINYNKF

SEQ ID NO: 3201 - protein, 9 aa, Homo Sapiens
DWNREVLKR

SEQ ID NO: 3202 - protein, 9 aa, Homo Sapiens
RKKATAFFP

SEQ ID NO: 3203 - protein, 9 aa, Homo Sapiens
AFFPDLVNM

SEQ ID NO: 3204 - protein, 9 aa, Homo Sapiens
NGCCCLEEK

SEQ ID NO: 3205 - protein, 9 aa, Homo Sapiens
GLHCTFIDD

SEQ ID NO: 3206 - protein, 9 aa, Homo Sapiens
VHCGTNVCR

SEQ ID NO: 3207 - protein, 9 aa, Homo Sapiens
HCGTNVCRK

SEQ ID NO: 3208 - protein, 9 aa, Homo Sapiens
VDIYGSVPE

SEQ ID NO: 3209 - protein, 9 aa, Homo Sapiens
RERADTRRW

SEQ ID NO: 3210 - protein, 9 aa, Homo Sapiens
NDSHVQISY

SEQ ID NO: 3211 - protein, 9 aa, Homo Sapiens
EPLPLAYAV

SEQ ID NO: 3212 - protein, 9 aa, Homo Sapiens
DISLDCDLN

SEQ ID NO: 3213 - protein, 9 aa, Homo Sapiens
VDKRQWVWG

SEQ ID NO: 3214 - protein, 9 aa, Homo Sapiens
RQWVWGPSG

SEQ ID NO: 3215 - protein, 9 aa, Homo Sapiens
GYGGILLVN

SEQ ID NO: 3216 - protein, 9 aa, Homo Sapiens
EDMSVMVLR

SEQ ID NO: 3217 - protein, 9 aa, Homo Sapiens
TQGPAALFD

SEQ ID NO: 3218 - protein, 9 aa, Homo Sapiens
FDDHKLVLH

SEQ ID NO: 3219 - protein, 9 aa, Homo Sapiens
ICGPEDVCE

SEQ ID NO: 3220 - protein, 9 aa, Homo Sapiens
GPEDVCEAY

SEQ ID NO: 3221 - protein, 9 aa, Homo Sapiens
SFPDAGFTG

SEQ ID NO: 3222 - protein, 9 aa, Homo Sapiens
GFTGLISFH

SEQ ID NO: 3223 - protein, 9 aa, Homo Sapiens
LISFHVTLL

SEQ ID NO: 3224 - protein, 9 aa, Homo Sapiens
SPIFTDTVV

SEQ ID NO: 3225 - protein, 9 aa, Homo Sapiens
WIMTPSTLP

SEQ ID NO: 3226 - protein, 9 aa, Homo Sapiens
LEVYVCRVR

SEQ ID NO: 3227 - protein, 9 aa, Homo Sapiens
VCRVRNNTC

SEQ ID NO: 3228 - protein, 9 aa, Homo Sapiens
VDAVAELAR

SEQ ID NO: 3229 - protein, 9 aa, Homo Sapiens
WIQDEMELG

SEQ ID NO: 3230 - protein, 9 aa, Homo Sapiens
KTLPVVFDS

SEQ ID NO: 3231 - protein, 9 aa, Homo Sapiens
FPYKRILGP

SEQ ID NO: 3232 - protein, 9 aa, Homo Sapiens
FGYVTREPR

SEQ ID NO: 3233 - protein, 9 aa, Homo Sapiens
RDRSVSGLD

SEQ ID NO: 3234 - protein, 9 aa, Homo Sapiens
LEVSPPVVA

SEQ ID NO: 3235 - protein, 9 aa, Homo Sapiens
YPLGRILIG

SEQ ID NO: 3236 - protein, 9 aa, Homo Sapiens
GGNLPGSSG

SEQ ID NO: 3237 - protein, 9 aa, Homo Sapiens
AQKVQPPVE

SEQ ID NO: 3238 - protein, 9 aa, Homo Sapiens
APDGKGFRM

SEQ ID NO: 3239 - protein, 9 aa, Homo Sapiens
KCGHGRALL

SEQ ID NO: 3240 - protein, 9 aa, Homo Sapiens
KRELGLAEC

SEQ ID NO: 3241 - protein, 9 aa, Homo Sapiens
PDLVNMLVL

SEQ ID NO: 3242 - protein, 9 aa, Homo Sapiens
GIPKPFGPI

SEQ ID NO: 3243 - protein, 9 aa, Homo Sapiens
IPKPFGPII

SEQ ID NO: 3244 - protein, 9 aa, Homo Sapiens
CCCLEEKVR

SEQ ID NO: 3245 - protein, 9 aa, Homo Sapiens
MSLQRIVRV

SEQ ID NO: 3246 - protein, 9 aa, Homo Sapiens
PTSAVCVAG

SEQ ID NO: 3247 - protein, 9 aa, Homo Sapiens
VCVAGVETL

SEQ ID NO: 3248 - protein, 9 aa, Homo Sapiens
AGVETLVDI

SEQ ID NO: 3249 - protein, 9 aa, Homo Sapiens
MERGRERAD

SEQ ID NO: 3250 - protein, 9 aa, Homo Sapiens
GRERADTRR

SEQ ID NO: 3251 - protein, 9 aa, Homo Sapiens
ERADTRRWR

SEQ ID NO: 3252 - protein, 9 aa, Homo Sapiens
ADTRRWRFD

SEQ ID NO: 3253 - protein, 9 aa, Homo Sapiens
ISLDCDLNC

SEQ ID NO: 3254 - protein, 9 aa, Homo Sapiens
LNCEGRQDR

SEQ ID NO: 3255 - protein, 9 aa, Homo Sapiens
CDRDDPSCD

SEQ ID NO: 3256 - protein, 9 aa, Homo Sapiens
LFDDHKLVL

SEQ ID NO: 3257 - protein, 9 aa, Homo Sapiens
AKRAQVFHI

SEQ ID NO: 3258 - protein, 9 aa, Homo Sapiens
DKVSYEVPR

SEQ ID NO: 3259 - protein, 9 aa, Homo Sapiens
PRLHGDEER

SEQ ID NO: 3260 - protein, 9 aa, Homo Sapiens
ASPIFTDTV

SEQ ID NO: 3261 - protein, 9 aa, Homo Sapiens
IMTPSTLPP

SEQ ID NO: 3262 - protein, 9 aa, Homo Sapiens
CRVRNNTCF

SEQ ID NO: 3263 - protein, 9 aa, Homo Sapiens
RNNTCFVDA

SEQ ID NO: 3264 - protein, 9 aa, Homo Sapiens
NTCFVDAVA

SEQ ID NO: 3265 - protein, 9 aa, Homo Sapiens
TCFVDAVAE

SEQ ID NO: 3266 - protein, 9 aa, Homo Sapiens
ARKAGCKLT

SEQ ID NO: 3267 - protein, 9 aa, Homo Sapiens
RWIQDEMEL

SEQ ID NO: 3268 - protein, 9 aa, Homo Sapiens
DEMELGYVQ

SEQ ID NO: 3269 - protein, 9 aa, Homo Sapiens
LGPDFGYVT

SEQ ID NO: 3270 - protein, 9 aa, Homo Sapiens
SFGNLEVSP

SEQ ID NO: 3271 - protein, 9 aa, Homo Sapiens
GRILIGGNL

SEQ ID NO: 3272 - protein, 9 aa, Homo Sapiens
RRVTQVVRD

SEQ ID NO: 3273 - protein, 9 aa, Homo Sapiens
RDFLHAQKV

SEQ ID NO: 3274 - protein, 9 aa, Homo Sapiens
LFVDWLAVG

SEQ ID NO: 3275 - protein, 9 aa, Homo Sapiens
PAPDGKGFR

SEQ ID NO: 3276 - protein, 9 aa, Homo Sapiens
GFRMLLASP

SEQ ID NO: 3277 - protein, 9 aa, Homo Sapiens
QKCGHGRAL

SEQ ID NO: 3278 - protein, 9 aa, Homo Sapiens
HGRALLFQG

SEQ ID NO: 3279 - protein, 9 aa, Homo Sapiens
IDIPQLFKT

SEQ ID NO: 3280 - protein, 9 aa, Homo Sapiens
IPQLFKTER

SEQ ID NO: 3281 - protein, 9 aa, Homo Sapiens
ERKKATAFF

SEQ ID NO: 3282 - protein, 9 aa, Homo Sapiens
LGIPKPFGP

SEQ ID NO: 3283 - protein, 9 aa, Homo Sapiens
DFTPYHMLH

SEQ ID NO: 3284 - protein, 9 aa, Homo Sapiens
HMLHGEVHC

SEQ ID NO: 3285 - protein, 9 aa, Homo Sapiens
VSLEHPTSA

SEQ ID NO: 3286 - protein, 9 aa, Homo Sapiens
EHPTSAVCV

SEQ ID NO: 3287 - protein, 9 aa, Homo Sapiens
VAGVETLVD

SEQ ID NO: 3288 - protein, 9 aa, Homo Sapiens
GSVPEGTEM

SEQ ID NO: 3289 - protein, 9 aa, Homo Sapiens
EMFEVYGTP

SEQ ID NO: 3290 - protein, 9 aa, Homo Sapiens
VYGTPGVDI

SEQ ID NO: 3291 - protein, 9 aa, Homo Sapiens
ISPNMERGR

SEQ ID NO: 3292 - protein, 9 aa, Homo Sapiens
ERGRERADT

SEQ ID NO: 3293 - protein, 9 aa, Homo Sapiens
DTRRWRFDA

SEQ ID NO: 3294 - protein, 9 aa, Homo Sapiens
PSNDLNDSH

SEQ ID NO: 3295 - protein, 9 aa, Homo Sapiens
NDLNDSHVQ

SEQ ID NO: 3296 - protein, 9 aa, Homo Sapiens
DSHVQISYH

SEQ ID NO: 3297 - protein, 9 aa, Homo Sapiens
LAYAVLYLT

SEQ ID NO: 3298 - protein, 9 aa, Homo Sapiens
CEGRQDRNF

SEQ ID NO: 3299 - protein, 9 aa, Homo Sapiens
GRQDRNFVD

SEQ ID NO: 3300 - protein, 9 aa, Homo Sapiens
RNFVDKRQW

SEQ ID NO: 3301 - protein, 9 aa, Homo Sapiens
DDPSCDVQD

SEQ ID NO: 3302 - protein, 9 aa, Homo Sapiens
LRTQGPAAL

SEQ ID NO: 3303 - protein, 9 aa, Homo Sapiens
GPAALFDDH

SEQ ID NO: 3304 - protein, 9 aa, Homo Sapiens
DHKLVLHTS

SEQ ID NO: 3305 - protein, 9 aa, Homo Sapiens
HTSSYDAKR

SEQ ID NO: 3306 - protein, 9 aa, Homo Sapiens
SSYDAKRAQ

SEQ ID NO: 3307 - protein, 9 aa, Homo Sapiens
PEDVCEAYR

SEQ ID NO: 3308 - protein, 9 aa, Homo Sapiens
EDVCEAYRH

SEQ ID NO: 3309 - protein, 9 aa, Homo Sapiens
VCEAYRHVL

SEQ ID NO: 3310 - protein, 9 aa, Homo Sapiens
CEAYRHVLG

SEQ ID NO: 3311 - protein, 9 aa, Homo Sapiens
RHVLGQDKV

SEQ ID NO: 3312 - protein, 9 aa, Homo Sapiens
QDKVSYEVP

SEQ ID NO: 3313 - protein, 9 aa, Homo Sapiens
VPRLHGDEE

SEQ ID NO: 3314 - protein, 9 aa, Homo Sapiens
GDEERFFVE

SEQ ID NO: 3315 - protein, 9 aa, Homo Sapiens
DEERFFVEG

SEQ ID NO: 3316 - protein, 9 aa, Homo Sapiens
LSFPDAGFT

SEQ ID NO: 3317 - protein, 9 aa, Homo Sapiens
TGLISFHVT

SEQ ID NO: 3318 - protein, 9 aa, Homo Sapiens
SNEDFSASP

SEQ ID NO: 3319 - protein, 9 aa, Homo Sapiens
PQAENRNDR

SEQ ID NO: 3320 - protein, 9 aa, Homo Sapiens
AENRNDRWI

SEQ ID NO: 3321 - protein, 9 aa, Homo Sapiens
RNDRWIQDE

SEQ ID NO: 3322 - protein, 9 aa, Homo Sapiens
APHKTLPVV

SEQ ID NO: 3323 - protein, 9 aa, Homo Sapiens
LPVVFDSPR

SEQ ID NO: 3324 - protein, 9 aa, Homo Sapiens
NGELQDFPY

SEQ ID NO: 3325 - protein, 9 aa, Homo Sapiens
TREPRDRSV

SEQ ID NO: 3326 - protein, 9 aa, Homo Sapiens
VSPPVVANG

SEQ ID NO: 3327 - protein, 9 aa, Homo Sapiens
IGGNLPGSS

SEQ ID NO: 3328 - protein, 9 aa, Homo Sapiens
PGSSGRRVT

SEQ ID NO: 3329 - protein, 9 aa, Homo Sapiens
QKVQPPVEL

SEQ ID NO: 3330 - protein, 9 aa, Homo Sapiens
VQPPVELFV

SEQ ID NO: 3331 - protein, 9 aa, Homo Sapiens
FRMLLASPG

SEQ ID NO: 3332 - protein, 9 aa, Homo Sapiens
RMLLASPGA

SEQ ID NO: 3333 - protein, 9 aa, Homo Sapiens
SPGACFKLF

SEQ ID NO: 3334 - protein, 9 aa, Homo Sapiens
EKQKCGHGR

SEQ ID NO: 3335 - protein, 9 aa, Homo Sapiens
KQKCGHGRA

SEQ ID NO: 3336 - protein, 9 aa, Homo Sapiens
REVLKRELG

SEQ ID NO: 3337 - protein, 9 aa, Homo Sapiens
CDIIDIPQL

SEQ ID NO: 3338 - protein, 9 aa, Homo Sapiens
TAFFPDLVN

SEQ ID NO: 3339 - protein, 9 aa, Homo Sapiens
VNMLVLGKH

SEQ ID NO: 3340 - protein, 9 aa, Homo Sapiens
GPIINGCCC

SEQ ID NO: 3341 - protein, 9 aa, Homo Sapiens
CCLEEKVRS

SEQ ID NO: 3342 - protein, 9 aa, Homo Sapiens
SFKWWNMVP

SEQ ID NO: 3343 - protein, 9 aa, Homo Sapiens
NMERGRERA

SEQ ID NO: 3344 - protein, 9 aa, Homo Sapiens
TRRWRFDAT

SEQ ID NO: 3345 - protein, 9 aa, Homo Sapiens
RFDATLEII

SEQ ID NO: 3346 - protein, 9 aa, Homo Sapiens
LEIIVVMNS

SEQ ID NO: 3347 - protein, 9 aa, Homo Sapiens
ISYHSSHEP

SEQ ID NO: 3348 - protein, 9 aa, Homo Sapiens
VWGPSGYGG

SEQ ID NO: 3349 - protein, 9 aa, Homo Sapiens
GPSGYGGIL

SEQ ID NO: 3350 - protein, 9 aa, Homo Sapiens
DQHVHCLQD

SEQ ID NO: 3351 - protein, 9 aa, Homo Sapiens
FHICGPEDV

SEQ ID NO: 3352 - protein, 9 aa, Homo Sapiens
FFVEGLSFP

SEQ ID NO: 3353 - protein, 9 aa, Homo Sapiens
DAGFTGLIS

SEQ ID NO: 3354 - protein, 9 aa, Homo Sapiens
ISFHVTLLD

SEQ ID NO: 3355 - protein, 9 aa, Homo Sapiens
VTLLDDSNE

SEQ ID NO: 3356 - protein, 9 aa, Homo Sapiens
NEDFSASPI

SEQ ID NO: 3357 - protein, 9 aa, Homo Sapiens
DTVVFRVAP

SEQ ID NO: 3358 - protein, 9 aa, Homo Sapiens
APWIMTPST

SEQ ID NO: 3359 - protein, 9 aa, Homo Sapiens
LARKAGCKL

SEQ ID NO: 3360 - protein, 9 aa, Homo Sapiens
LTICPQAEN

SEQ ID NO: 3361 - protein, 9 aa, Homo Sapiens
NRNDRWIQD

SEQ ID NO: 3362 - protein, 9 aa, Homo Sapiens
QAPHKTLPV

SEQ ID NO: 3363 - protein, 9 aa, Homo Sapiens
FDSPRNGEL

SEQ ID NO: 3364 - protein, 9 aa, Homo Sapiens
DSPRNGELQ

SEQ ID NO: 3365 - protein, 9 aa, Homo Sapiens
PRNGELQDF

SEQ ID NO: 3366 - protein, 9 aa, Homo Sapiens
PRDRSVSGL

SEQ ID NO: 3367 - protein, 9 aa, Homo Sapiens
DRSVSGLDS

SEQ ID NO: 3368 - protein, 9 aa, Homo Sapiens
DSFGNLEVS

SEQ ID NO: 3369 - protein, 9 aa, Homo Sapiens
TQVVRDFLH

SEQ ID NO: 3370 - protein, 9 aa, Homo Sapiens
DFLHAQKVQ

SEQ ID NO: 3371 - protein, 9 aa, Homo Sapiens
QPPVELFVD

SEQ ID NO: 3372 - protein, 9 aa, Homo Sapiens
LAVGHVDEF

SEQ ID NO: 3373 - protein, 9 aa, Homo Sapiens
GHGRALLFQ

SEQ ID NO: 3374 - protein, 9 aa, Homo Sapiens
LSNKDLINY

SEQ ID NO: 3375 - protein, 9 aa, Homo Sapiens
EEKVRSLLE

SEQ ID NO: 3376 - protein, 9 aa, Homo Sapiens
EKVRSLLEP

SEQ ID NO: 3377 - protein, 9 aa, Homo Sapiens
YGSVPEGTE

SEQ ID NO: 3378 - protein, 9 aa, Homo Sapiens
DATLEIIVV

SEQ ID NO: 3379 - protein, 9 aa, Homo Sapiens
SNDLNDSHV

SEQ ID NO: 3380 - protein, 9 aa, Homo Sapiens
DCDLNCEGR

SEQ ID NO: 3381 - protein, 9 aa, Homo Sapiens
KRQWVWGPS

SEQ ID NO: 3382 - protein, 9 aa, Homo Sapiens
PSGYGGILL

SEQ ID NO: 3383 - protein, 9 aa, Homo Sapiens
YGGILLVNC

SEQ ID NO: 3384 - protein, 9 aa, Homo Sapiens
NCDRDDPSC

SEQ ID NO: 3385 - protein, 9 aa, Homo Sapiens
DNCDQHVHC

SEQ ID NO: 3386 - protein, 9 aa, Homo Sapiens
LEDMSVMVL

SEQ ID NO: 3387 - protein, 9 aa, Homo Sapiens
MSVMVLRTQ

SEQ ID NO: 3388 - protein, 9 aa, Homo Sapiens
AALFDDHKL

SEQ ID NO: 3389 - protein, 9 aa, Homo Sapiens
HKLVLHTSS

SEQ ID NO: 3390 - protein, 9 aa, Homo Sapiens
KRAQVFHIC

SEQ ID NO: 3391 - protein, 9 aa, Homo Sapiens
LGQDKVSYE

SEQ ID NO: 3392 - protein, 9 aa, Homo Sapiens
SYEVPRLHG

SEQ ID NO: 3393 - protein, 9 aa, Homo Sapiens
YEVPRLHGD

SEQ ID NO: 3394 - protein, 9 aa, Homo Sapiens
LHGDEERFF

SEQ ID NO: 3395 - protein, 9 aa, Homo Sapiens
FPDAGFTGL

SEQ ID NO: 3396 - protein, 9 aa, Homo Sapiens
DSNEDFSAS

SEQ ID NO: 3397 - protein, 9 aa, Homo Sapiens
FSASPIFTD

SEQ ID NO: 3398 - protein, 9 aa, Homo Sapiens
SASPIFTDT

SEQ ID NO: 3399 - protein, 9 aa, Homo Sapiens
TDTVVFRVA

SEQ ID NO: 3400 - protein, 9 aa, Homo Sapiens
PSTLPPLEV

SEQ ID NO: 3401 - protein, 9 aa, Homo Sapiens
LPPLEVYVC

SEQ ID NO: 3402 - protein, 9 aa, Homo Sapiens
VRNNTCFVD

SEQ ID NO: 3403 - protein, 9 aa, Homo Sapiens
KAGCKLTIC

SEQ ID NO: 3404 - protein, 9 aa, Homo Sapiens
CKLTICPQA

SEQ ID NO: 3405 - protein, 9 aa, Homo Sapiens
QAENRNDRW

SEQ ID NO: 3406 - protein, 9 aa, Homo Sapiens
ENRNDRWIQ

SEQ ID NO: 3407 - protein, 9 aa, Homo Sapiens
MELGYVQAP

SEQ ID NO: 3408 - protein, 9 aa, Homo Sapiens
VQAPHKTLP

SEQ ID NO: 3409 - protein, 9 aa, Homo Sapiens
HKTLPVVFD

SEQ ID NO: 3410 - protein, 9 aa, Homo Sapiens
RNGELQDFP

SEQ ID NO: 3411 - protein, 9 aa, Homo Sapiens
QDFPYKRIL

SEQ ID NO: 3412 - protein, 9 aa, Homo Sapiens
PYKRILGPD

SEQ ID NO: 3413 - protein, 9 aa, Homo Sapiens
VTREPRDRS

SEQ ID NO: 3414 - protein, 9 aa, Homo Sapiens
SGLDSFGNL

SEQ ID NO: 3415 - protein, 9 aa, Homo Sapiens
LDSFGNLEV

SEQ ID NO: 3416 - protein, 9 aa, Homo Sapiens
LGRILIGGN

SEQ ID NO: 3417 - protein, 9 aa, Homo Sapiens
PPVELFVDW

SEQ ID NO: 3418 - protein, 9 aa, Homo Sapiens
DEFLSFVPA

SEQ ID NO: 3419 - protein, 9 aa, Homo Sapiens
DGKGFRMLL

SEQ ID NO: 3420 - protein, 9 aa, Homo Sapiens
GKGFRMLLA

SEQ ID NO: 3421 - protein, 9 aa, Homo Sapiens
ASPGACFKL

SEQ ID NO: 3422 - protein, 9 aa, Homo Sapiens
QEKQKCGHG

SEQ ID NO: 3423 - protein, 9 aa, Homo Sapiens
QGVVDDEQV

SEQ ID NO: 3424 - protein, 9 aa, Homo Sapiens
VDDEQVKTI

SEQ ID NO: 3425 - protein, 9 aa, Homo Sapiens
YNKFVQSCI

SEQ ID NO: 3426 - protein, 9 aa, Homo Sapiens
SCIDWNREV

SEQ ID NO: 3427 - protein, 9 aa, Homo Sapiens
WNREVLKRE

SEQ ID NO: 3428 - protein, 9 aa, Homo Sapiens
KATAFFPDL

SEQ ID NO: 3429 - protein, 9 aa, Homo Sapiens
ATAFFPDLV

SEQ ID NO: 3430 - protein, 9 aa, Homo Sapiens
NMLVLGKHL

SEQ ID NO: 3431 - protein, 9 aa, Homo Sapiens
KPFGPIING

SEQ ID NO: 3432 - protein, 9 aa, Homo Sapiens
INGCCCLEE

SEQ ID NO: 3433 - protein, 9 aa, Homo Sapiens
LEEKVRSLL

SEQ ID NO: 3434 - protein, 9 aa, Homo Sapiens
CTFIDDFTP

SEQ ID NO: 3435 - protein, 9 aa, Homo Sapiens
HGEVHCGTN

SEQ ID NO: 3436 - protein, 9 aa, Homo Sapiens
GTNVCRKPF

SEQ ID NO: 3437 - protein, 9 aa, Homo Sapiens
RKPFSFKWW

SEQ ID NO: 3438 - protein, 9 aa, Homo Sapiens
HPTSAVCVA

SEQ ID NO: 3439 - protein, 9 aa, Homo Sapiens
TSAVCVAGV

SEQ ID NO: 3440 - protein, 9 aa, Homo Sapiens
IYGSVPEGT

SEQ ID NO: 3441 - protein, 9 aa, Homo Sapiens
GTEMFEVYG

SEQ ID NO: 3442 - protein, 9 aa, Homo Sapiens
MFEVYGTPG

SEQ ID NO: 3443 - protein, 9 aa, Homo Sapiens
WRFDATLEI

SEQ ID NO: 3444 - protein, 9 aa, Homo Sapiens
HSSHEPLPL

SEQ ID NO: 3445 - protein, 9 aa, Homo Sapiens
HEPLPLAYA

SEQ ID NO: 3446 - protein, 9 aa, Homo Sapiens
TCVDISLDC

SEQ ID NO: 3447 - protein, 9 aa, Homo Sapiens
CDLNCEGRQ

SEQ ID NO: 3448 - protein, 9 aa, Homo Sapiens
NCEGRQDRN

SEQ ID NO: 3449 - protein, 9 aa, Homo Sapiens
EGRQDRNFV

SEQ ID NO: 3450 - protein, 9 aa, Homo Sapiens
NFVDKRQWV

SEQ ID NO: 3451 - protein, 9 aa, Homo Sapiens
GGILLVNCD

SEQ ID NO: 3452 - protein, 9 aa, Homo Sapiens
VHCLQDLED

SEQ ID NO: 3453 - protein, 9 aa, Homo Sapiens
LQDLEDMSV

SEQ ID NO: 3454 - protein, 9 aa, Homo Sapiens
QGPAALFDD

SEQ ID NO: 3455 - protein, 9 aa, Homo Sapiens
RAQVFHICG

SEQ ID NO: 3456 - protein, 9 aa, Homo Sapiens
VFHICGPED

SEQ ID NO: 3457 - protein, 9 aa, Homo Sapiens
EGLSFPDAG

SEQ ID NO: 3458 - protein, 9 aa, Homo Sapiens
PDAGFTGLI

SEQ ID NO: 3459 - protein, 9 aa, Homo Sapiens
SFHVTLLDD

SEQ ID NO: 3460 - protein, 9 aa, Homo Sapiens
EDFSASPIF

SEQ ID NO: 3461 - protein, 9 aa, Homo Sapiens
VFRVAPWIM

SEQ ID NO: 3462 - protein, 9 aa, Homo Sapiens
CFVDAVAEL

SEQ ID NO: 3463 - protein, 9 aa, Homo Sapiens
FGNLEVSPP

SEQ ID NO: 3464 - protein, 9 aa, Homo Sapiens
GNLEVSPPV

SEQ ID NO: 3465 - protein, 9 aa, Homo Sapiens
EYPLGRILI

SEQ ID NO: 3466 - protein, 9 aa, Homo Sapiens
VDEFLSFVP

SEQ ID NO: 3467 - protein, 9 aa, Homo Sapiens
PGACFKLFQ

SEQ ID NO: 3468 - protein, 9 aa, Homo Sapiens
GACFKLFQE

SEQ ID NO: 3469 - protein, 9 aa, Homo Sapiens
FQEKQKCGH

SEQ ID NO: 3470 - protein, 9 aa, Homo Sapiens
VKTISINQV

SEQ ID NO: 3471 - protein, 9 aa, Homo Sapiens
VQSCIDWNR

SEQ ID NO: 3472 - protein, 9 aa, Homo Sapiens
LGLAECDII

SEQ ID NO: 3473 - protein, 9 aa, Homo Sapiens
AECDIIDIP

SEQ ID NO: 3474 - protein, 9 aa, Homo Sapiens
FKTERKKAT

SEQ ID NO: 3475 - protein, 9 aa, Homo Sapiens
KKATAFFPD

SEQ ID NO: 3476 - protein, 9 aa, Homo Sapiens
LHCTFIDDF

SEQ ID NO: 3477 - protein, 9 aa, Homo Sapiens
TPYHMLHGE

SEQ ID NO: 3478 - protein, 9 aa, Homo Sapiens
GEVHCGTNV

SEQ ID NO: 3479 - protein, 9 aa, Homo Sapiens
CRKPFSFKW

SEQ ID NO: 3480 - protein, 9 aa, Homo Sapiens
KPFSFKWWN

SEQ ID NO: 3481 - protein, 9 aa, Homo Sapiens
VPEGTEMFE

SEQ ID NO: 3482 - protein, 9 aa, Homo Sapiens
GTPGVDIYI

SEQ ID NO: 3483 - protein, 9 aa, Homo Sapiens
PGVDIYISP

SEQ ID NO: 3484 - protein, 9 aa, Homo Sapiens
VDIYISPNM

SEQ ID NO: 3485 - protein, 9 aa, Homo Sapiens
SPNMERGRE

SEQ ID NO: 3486 - protein, 9 aa, Homo Sapiens
MNSPSNDLN

SEQ ID NO: 3487 - protein, 9 aa, Homo Sapiens
NSPSNDLND

SEQ ID NO: 3488 - protein, 9 aa, Homo Sapiens
LTCVDISLD

SEQ ID NO: 3489 - protein, 9 aa, Homo Sapiens
VDISLDCDL

SEQ ID NO: 3490 - protein, 9 aa, Homo Sapiens
DKRQWVWGP

SEQ ID NO: 3491 - protein, 9 aa, Homo Sapiens
WGPSGYGGI

SEQ ID NO: 3492 - protein, 9 aa, Homo Sapiens
VNCDRDDPS

SEQ ID NO: 3493 - protein, 9 aa, Homo Sapiens
DMSVMVLRT

SEQ ID NO: 3494 - protein, 9 aa, Homo Sapiens
VMVLRTQGP

SEQ ID NO: 3495 - protein, 9 aa, Homo Sapiens
DDHKLVLHT

SEQ ID NO: 3496 - protein, 9 aa, Homo Sapiens
TSSYDAKRA

SEQ ID NO: 3497 - protein, 9 aa, Homo Sapiens
AQVFHICGP

SEQ ID NO: 3498 - protein, 9 aa, Homo Sapiens
EERFFVEGL

SEQ ID NO: 3499 - protein, 9 aa, Homo Sapiens
DDSNEDFSA

SEQ ID NO: 3500 - protein, 9 aa, Homo Sapiens
DFSASPIFT

SEQ ID NO: 3501 - protein, 9 aa, Homo Sapiens
FRVAPWIMT

SEQ ID NO: 3502 - protein, 9 aa, Homo Sapiens
VAELARKAG

SEQ ID NO: 3503 - protein, 9 aa, Homo Sapiens
AGCKLTICP

SEQ ID NO: 3504 - protein, 9 aa, Homo Sapiens
NDRWIQDEM

SEQ ID NO: 3505 - protein, 9 aa, Homo Sapiens
QDEMELGYV

SEQ ID NO: 3506 - protein, 9 aa, Homo Sapiens
PDFGYVTRE

SEQ ID NO: 3507 - protein, 9 aa, Homo Sapiens
VANGKEYPL

SEQ ID NO: 3508 - protein, 9 aa, Homo Sapiens
ANGKEYPLG

SEQ ID NO: 3509 - protein, 9 aa, Homo Sapiens
LPGSSGRRV

SEQ ID NO: 3510 - protein, 9 aa, Homo Sapiens
VELFVDWLA

SEQ ID NO: 3511 - protein, 9 aa, Homo Sapiens
EFLSFVPAP

SEQ ID NO: 3512 - protein, 9 aa, Homo Sapiens
LSFVPAPDG

SEQ ID NO: 3513 - protein, 9 aa, Homo Sapiens
PDGKGFRML

SEQ ID NO: 3514 - protein, 9 aa, Homo Sapiens
LFQGVVDDE

SEQ ID NO: 3515 - protein, 9 aa, Homo Sapiens
DEQVKTISI

SEQ ID NO: 3516 - protein, 9 aa, Homo Sapiens
EQVKTISIN

SEQ ID NO: 3517 - protein, 9 aa, Homo Sapiens
SNKDLINYN

SEQ ID NO: 3518 - protein, 9 aa, Homo Sapiens
KFVQSCIDW

SEQ ID NO: 3519 - protein, 9 aa, Homo Sapiens
QSCIDWNRE

SEQ ID NO: 3520 - protein, 9 aa, Homo Sapiens
FPDLVNMLV

SEQ ID NO: 3521 - protein, 9 aa, Homo Sapiens
GKHLGIPKP

SEQ ID NO: 3522 - protein, 9 aa, Homo Sapiens
PKPFGPIIN

SEQ ID NO: 3523 - protein, 9 aa, Homo Sapiens
PFGPIINGC

SEQ ID NO: 3524 - protein, 9 aa, Homo Sapiens
LEPLGLHCT

SEQ ID NO: 3525 - protein, 9 aa, Homo Sapiens
IDDFTPYHM

SEQ ID NO: 3526 - protein, 9 aa, Homo Sapiens
FTPYHMLHG

SEQ ID NO: 3527 - protein, 9 aa, Homo Sapiens
VETLVDIYG

SEQ ID NO: 3528 - protein, 9 aa, Homo Sapiens
ETLVDIYGS

SEQ ID NO: 3529 - protein, 9 aa, Homo Sapiens
FEVYGTPGV

SEQ ID NO: 3530 - protein, 9 aa, Homo Sapiens
SPSNDLNDS

SEQ ID NO: 3531 - protein, 9 aa, Homo Sapiens
SSHEPLPLA

SEQ ID NO: 3532 - protein, 9 aa, Homo Sapiens
YAVLYLTCV

SEQ ID NO: 3533 - protein, 9 aa, Homo Sapiens
LYLTCVDIS

SEQ ID NO: 3534 - protein, 9 aa, Homo Sapiens
PSCDVQDNC

SEQ ID NO: 3535 - protein, 9 aa, Homo Sapiens
QHVHCLQDL

SEQ ID NO: 3536 - protein, 9 aa, Homo Sapiens
HCLQDLEDM

SEQ ID NO: 3537 - protein, 9 aa, Homo Sapiens
HGDEERFFV

SEQ ID NO: 3538 - protein, 9 aa, Homo Sapiens
ERFFVEGLS

SEQ ID NO: 3539 - protein, 9 aa, Homo Sapiens
VYVCRVRNN

SEQ ID NO: 3540 - protein, 9 aa, Homo Sapiens
GCKLTICPQ

SEQ ID NO: 3541 - protein, 9 aa, Homo Sapiens
ICPQAENRN

SEQ ID NO: 3542 - protein, 9 aa, Homo Sapiens
CPQAENRND

SEQ ID NO: 3543 - protein, 9 aa, Homo Sapiens
DRWIQDEME

SEQ ID NO: 3544 - protein, 9 aa, Homo Sapiens
DFPYKRILG

SEQ ID NO: 3545 - protein, 9 aa, Homo Sapiens
GYVTREPRD

SEQ ID NO: 3546 - protein, 9 aa, Homo Sapiens
VTQVVRDFL

SEQ ID NO: 3547 - protein, 9 aa, Homo Sapiens
LHAQKVQPP

SEQ ID NO: 3548 - protein, 9 aa, Homo Sapiens
VDWLAVGHV

SEQ ID NO: 3549 - protein, 9 aa, Homo Sapiens
CFKLFQEKQ

SEQ ID NO: 3550 - protein, 9 aa, Homo Sapiens
LFQEKQKCG

SEQ ID NO: 3551 - protein, 9 aa, Homo Sapiens
GRALLFQGV

SEQ ID NO: 3552 - protein, 9 aa, Homo Sapiens
DDEQVKTIS

SEQ ID NO: 3553 - protein, 9 aa, Homo Sapiens
INQVLSNKD

SEQ ID NO: 3554 - protein, 9 aa, Homo Sapiens
NYNKFVQSC

SEQ ID NO: 3555 - protein, 9 aa, Homo Sapiens
LFKTERKKA

SEQ ID NO: 3556 - protein, 9 aa, Homo Sapiens
FFPDLVNML

SEQ ID NO: 3557 - protein, 9 aa, Homo Sapiens
FGPIINGCC

SEQ ID NO: 3558 - protein, 9 aa, Homo Sapiens
LGLHCTFID

SEQ ID NO: 3559 - protein, 9 aa, Homo Sapiens
LHGEVHCGT

SEQ ID NO: 3560 - protein, 9 aa, Homo Sapiens
CGTNVCRKP

SEQ ID NO: 3561 - protein, 9 aa, Homo Sapiens
TNVCRKPFS

SEQ ID NO: 3562 - protein, 9 aa, Homo Sapiens
FDATLEIIV

SEQ ID NO: 3563 - protein, 9 aa, Homo Sapiens
SHVQISYHS

SEQ ID NO: 3564 - protein, 9 aa, Homo Sapiens
SYHSSHEPL

SEQ ID NO: 3565 - protein, 9 aa, Homo Sapiens
LDCDLNCEG

SEQ ID NO: 3566 - protein, 9 aa, Homo Sapiens
DRNFVDKRQ

SEQ ID NO: 3567 - protein, 9 aa, Homo Sapiens
DRDDPSCDV

SEQ ID NO: 3568 - protein, 9 aa, Homo Sapiens
SCDVQDNCD

SEQ ID NO: 3569 - protein, 9 aa, Homo Sapiens
VQDNCDQHV

SEQ ID NO: 3570 - protein, 9 aa, Homo Sapiens
CDQHVHCLQ

SEQ ID NO: 3571 - protein, 9 aa, Homo Sapiens
CGPEDVCEA

SEQ ID NO: 3572 - protein, 9 aa, Homo Sapiens
GQDKVSYEV

SEQ ID NO: 3573 - protein, 9 aa, Homo Sapiens
VEGLSFPDA

SEQ ID NO: 3574 - protein, 9 aa, Homo Sapiens
FTGLISFHV

SEQ ID NO: 3575 - protein, 9 aa, Homo Sapiens
FTDTVVFRV

SEQ ID NO: 3576 - protein, 9 aa, Homo Sapiens
VAPWIMTPS

SEQ ID NO: 3577 - protein, 9 aa, Homo Sapiens
TPSTLPPLE

SEQ ID NO: 3578 - protein, 9 aa, Homo Sapiens
NNTCFVDAV

SEQ ID NO: 3579 - protein, 9 aa, Homo Sapiens
GYVQAPHKT

SEQ ID NO: 3580 - protein, 9 aa, Homo Sapiens
VFDSPRNGE

SEQ ID NO: 3581 - protein, 9 aa, Homo Sapiens
DFGYVTREP

SEQ ID NO: 3582 - protein, 9 aa, Homo Sapiens
VSGLDSFGN

SEQ ID NO: 3583 - protein, 9 aa, Homo Sapiens
PPVVANGKE

SEQ ID NO: 3584 - protein, 9 aa, Homo Sapiens
GKEYPLGRI

SEQ ID NO: 3585 - protein, 9 aa, Homo Sapiens
HAQKVQPPV

SEQ ID NO: 3586 - protein, 9 aa, Homo Sapiens
FQGVVDDEQ

SEQ ID NO: 3587 - protein, 9 aa, Homo Sapiens
NQVLSNKDL

SEQ ID NO: 3588 - protein, 9 aa, Homo Sapiens
ECDIIDIPQ

SEQ ID NO: 3589 - protein, 9 aa, Homo Sapiens
VRSLLEPLG

SEQ ID NO: 3590 - protein, 9 aa, Homo Sapiens
DDFTPYHML

SEQ ID NO: 3591 - protein, 9 aa, Homo Sapiens
PYHMLHGEV

SEQ ID NO: 3592 - protein, 9 aa, Homo Sapiens
PFSFKWWNM

SEQ ID NO: 3593 - protein, 9 aa, Homo Sapiens
FSFKWWNMV

SEQ ID NO: 3594 - protein, 9 aa, Homo Sapiens
TLAPLEVYV

SEQ ID NO: 3595 - protein, 9 aa, Homo Sapiens
STLAPLEVY

SEQ ID NO: 3596 - protein, 9 aa, Homo Sapiens
APLEVYVCR

SEQ ID NO: 3597 - protein, 9 aa, Homo Sapiens
WIMTPSTLA

SEQ ID NO: 3598 - protein, 9 aa, Homo Sapiens
IMTPSTLAP

SEQ ID NO: 3599 - protein, 9 aa, Homo Sapiens
PSTLAPLEV

SEQ ID NO: 3600 - protein, 9 aa, Homo Sapiens
LAPLEVYVC

SEQ ID NO: 3601 - protein, 9 aa, Homo Sapiens
MTPSTLAPL

SEQ ID NO: 3602 - protein, 9 aa, Homo Sapiens
TPSTLAPLE

SEQ ID NO: 3603 - protein, 9 aa, Homo Sapiens
PVPDGKGFR

SEQ ID NO: 3604 - protein, 9 aa, Homo Sapiens
FLSFVPVPD

SEQ ID NO: 3605 - protein, 9 aa, Homo Sapiens
SFVPVPDGK

SEQ ID NO: 3606 - protein, 9 aa, Homo Sapiens
FVPVPDGKG

SEQ ID NO: 3607 - protein, 9 aa, Homo Sapiens
VPVPDGKGF

SEQ ID NO: 3608 - protein, 9 aa, Homo Sapiens
EFLSFVPVP

SEQ ID NO: 3609 - protein, 9 aa, Homo Sapiens
VPDGKGFRM

SEQ ID NO: 3610 - protein, 9 aa, Homo Sapiens
DEFLSFVPV

SEQ ID NO: 3611 - protein, 9 aa, Homo Sapiens
DIIDIPQLF

SEQ ID NO: 3612 - protein, 9 aa, Homo Sapiens
STLPPLEVY

SEQ ID NO: 3613 - protein, 9 aa, Homo Sapiens
KVQPPVELF

SEQ ID NO: 3614 - protein, 9 aa, Homo Sapiens
EVLKRELGL

SEQ ID NO: 3615 - protein, 9 aa, Homo Sapiens
GVETLVDIY

SEQ ID NO: 3616 - protein, 9 aa, Homo Sapiens
DIYGSVPEG

SEQ ID NO: 3617 - protein, 9 aa, Homo Sapiens
ATLEIIVVM

SEQ ID NO: 3618 - protein, 9 aa, Homo Sapiens
MTPSTLPPL

SEQ ID NO: 3619 - protein, 9 aa, Homo Sapiens
RVTQVVRDF

SEQ ID NO: 3620 - protein, 9 aa, Homo Sapiens
SVPEGTEMF

SEQ ID NO: 3621 - protein, 9 aa, Homo Sapiens
KVSYEVPRL

SEQ ID NO: 3622 - protein, 9 aa, Homo Sapiens
EVSPPVVAN

SEQ ID NO: 3623 - protein, 9 aa, Homo Sapiens
AFFPDLVNM

SEQ ID NO: 3624 - protein, 9 aa, Homo Sapiens
CLEEKVRSL

SEQ ID NO: 3625 - protein, 9 aa, Homo Sapiens
KVRSLLEPL

SEQ ID NO: 3626 - protein, 9 aa, Homo Sapiens
EIIVVMNSP

SEQ ID NO: 3627 - protein, 9 aa, Homo Sapiens
RTQGPAALF

SEQ ID NO: 3628 - protein, 9 aa, Homo Sapiens
DVCEAYRHV

SEQ ID NO: 3629 - protein, 9 aa, Homo Sapiens
PIFTDTVVF

SEQ ID NO: 3630 - protein, 9 aa, Homo Sapiens
RILGPDFGY

SEQ ID NO: 3631 - protein, 9 aa, Homo Sapiens
DIPQLFKTE

SEQ ID NO: 3632 - protein, 9 aa, Homo Sapiens
TFIDDFTPY

SEQ ID NO: 3633 - protein, 9 aa, Homo Sapiens
EGTEMFEVY

SEQ ID NO: 3634 - protein, 9 aa, Homo Sapiens
PLPLAYAVL

SEQ ID NO: 3635 - protein, 9 aa, Homo Sapiens
LISFHVTLL

SEQ ID NO: 3636 - protein, 9 aa, Homo Sapiens
PVELFVDWL

SEQ ID NO: 3637 - protein, 9 aa, Homo Sapiens
KTISINQVL

SEQ ID NO: 3638 - protein, 9 aa, Homo Sapiens
FFPDLVNML

SEQ ID NO: 3639 - protein, 9 aa, Homo Sapiens
NVCRKPFSF

SEQ ID NO: 3640 - protein, 9 aa, Homo Sapiens
ETLVDIYGS

SEQ ID NO: 3641 - protein, 9 aa, Homo Sapiens
PLAYAVLYL

SEQ ID NO: 3642 - protein, 9 aa, Homo Sapiens
VLGQDKVSY

SEQ ID NO: 3643 - protein, 9 aa, Homo Sapiens
RLHGDEERF

SEQ ID NO: 3644 - protein, 9 aa, Homo Sapiens
LLDDSNEDF

SEQ ID NO: 3645 - protein, 9 aa, Homo Sapiens
CFVDAVAEL

SEQ ID NO: 3646 - protein, 9 aa, Homo Sapiens
PVVANGKEY

SEQ ID NO: 3647 - protein, 9 aa, Homo Sapiens
LLASPGACF

SEQ ID NO: 3648 - protein, 9 aa, Homo Sapiens
DDFTPYHML

SEQ ID NO: 3649 - protein, 9 aa, Homo Sapiens
KLVLHTSSY

SEQ ID NO: 3650 - protein, 9 aa, Homo Sapiens
GLSFPDAGF

SEQ ID NO: 3651 - protein, 9 aa, Homo Sapiens
GLISFHVTL

SEQ ID NO: 3652 - protein, 9 aa, Homo Sapiens
EDFSASPIF

SEQ ID NO: 3653 - protein, 9 aa, Homo Sapiens
PIINGCCCL

SEQ ID NO: 3654 - protein, 9 aa, Homo Sapiens
GTNVCRKPF

SEQ ID NO: 3655 - protein, 9 aa, Homo Sapiens
EERFFVEGL

SEQ ID NO: 3656 - protein, 9 aa, Homo Sapiens
RFFVEGLSF

SEQ ID NO: 3657 - protein, 9 aa, Homo Sapiens
EFLSFVPAP

SEQ ID NO: 3658 - protein, 9 aa, Homo Sapiens
CIDWNREVL

SEQ ID NO: 3659 - protein, 9 aa, Homo Sapiens
ERKKATAFF

SEQ ID NO: 3660 - protein, 9 aa, Homo Sapiens
DLVNMLVLG

SEQ ID NO: 3661 - protein, 9 aa, Homo Sapiens
EPLGLHCTF

SEQ ID NO: 3662 - protein, 9 aa, Homo Sapiens
EVYGTPGVD

SEQ ID NO: 3663 - protein, 9 aa, Homo Sapiens
DIYISPNME

SEQ ID NO: 3664 - protein, 9 aa, Homo Sapiens
DLNDSHVQI

SEQ ID NO: 3665 - protein, 9 aa, Homo Sapiens
DVQDNCDQH

SEQ ID NO: 3666 - protein, 9 aa, Homo Sapiens
EVPRLHGDE

SEQ ID NO: 3667 - protein, 9 aa, Homo Sapiens
DTVVFRVAP

SEQ ID NO: 3668 - protein, 9 aa, Homo Sapiens
RVAPWIMTP

SEQ ID NO: 3669 - protein, 9 aa, Homo Sapiens
EVYVCRVRN

SEQ ID NO: 3670 - protein, 9 aa, Homo Sapiens
YVQAPHKTL

SEQ ID NO: 3671 - protein, 9 aa, Homo Sapiens
LIGGNLPGS

SEQ ID NO: 3672 - protein, 9 aa, Homo Sapiens
VTQVVRDFL

SEQ ID NO: 3673 - protein, 9 aa, Homo Sapiens
AVGHVDEFL

SEQ ID NO: 3674 - protein, 9 aa, Homo Sapiens
HVDEFLSFV

SEQ ID NO: 3675 - protein, 9 aa, Homo Sapiens
DGKGFRMLL

SEQ ID NO: 3676 - protein, 9 aa, Homo Sapiens
YISPNMERG

SEQ ID NO: 3677 - protein, 9 aa, Homo Sapiens
YLTCVDISL

SEQ ID NO: 3678 - protein, 9 aa, Homo Sapiens
DLEDMSVMV

SEQ ID NO: 3679 - protein, 9 aa, Homo Sapiens
AGFTGLISF

SEQ ID NO: 3680 - protein, 9 aa, Homo Sapiens
PRNGELQDF

SEQ ID NO: 3681 - protein, 9 aa, Homo Sapiens
ELFVDWLAV

SEQ ID NO: 3682 - protein, 9 aa, Homo Sapiens
LAVGHVDEF

SEQ ID NO: 3683 - protein, 9 aa, Homo Sapiens
SINQVLSNK

SEQ ID NO: 3684 - protein, 9 aa, Homo Sapiens
IVRVSLEHP

SEQ ID NO: 3685 - protein, 9 aa, Homo Sapiens
YGTPGVDIY

SEQ ID NO: 3686 - protein, 9 aa, Homo Sapiens
GVDIYISPN

SEQ ID NO: 3687 - protein, 9 aa, Homo Sapiens
DTRRWRFDA

SEQ ID NO: 3688 - protein, 9 aa, Homo Sapiens
HVQISYHSS

SEQ ID NO: 3689 - protein, 9 aa, Homo Sapiens
CVDISLDCD

SEQ ID NO: 3690 - protein, 9 aa, Homo Sapiens
DISLDCDLN

SEQ ID NO: 3691 - protein, 9 aa, Homo Sapiens
LFDDHKLVL

SEQ ID NO: 3692 - protein, 9 aa, Homo Sapiens
FTDTVVFRV

SEQ ID NO: 3693 - protein, 9 aa, Homo Sapiens
ELARKAGCK

SEQ ID NO: 3694 - protein, 9 aa, Homo Sapiens
KTLPVVFDS

SEQ ID NO: 3695 - protein, 9 aa, Homo Sapiens
ELQDFPYKR

SEQ ID NO: 3696 - protein, 9 aa, Homo Sapiens
PRDRSVSGL

SEQ ID NO: 3697 - protein, 9 aa, Homo Sapiens
RSVSGLDSF

SEQ ID NO: 3698 - protein, 9 aa, Homo Sapiens
VVRDFLHAQ

SEQ ID NO: 3699 - protein, 9 aa, Homo Sapiens
GHVDEFLSF

SEQ ID NO: 3700 - protein, 9 aa, Homo Sapiens
LLFQGVVDD

SEQ ID NO: 3701 - protein, 9 aa, Homo Sapiens
LSNKDLINY

SEQ ID NO: 3702 - protein, 9 aa, Homo Sapiens
DLINYNKFV

SEQ ID NO: 3703 - protein, 9 aa, Homo Sapiens
CDIIDIPQL

SEQ ID NO: 3704 - protein, 9 aa, Homo Sapiens
LVNMLVLGK

SEQ ID NO: 3705 - protein, 9 aa, Homo Sapiens
GIPKPFGPI

SEQ ID NO: 3706 - protein, 9 aa, Homo Sapiens
FTPYHMLHG

SEQ ID NO: 3707 - protein, 9 aa, Homo Sapiens
EVHCGTNVC

SEQ ID NO: 3708 - protein, 9 aa, Homo Sapiens
PFSFKWWNM

SEQ ID NO: 3709 - protein, 9 aa, Homo Sapiens
LTCVDISLD

SEQ ID NO: 3710 - protein, 9 aa, Homo Sapiens
DLNCEGRQD

SEQ ID NO: 3711 - protein, 9 aa, Homo Sapiens
QDLEDMSVM

SEQ ID NO: 3712 - protein, 9 aa, Homo Sapiens
LEDMSVMVL

SEQ ID NO: 3713 - protein, 9 aa, Homo Sapiens
TVVFRVAPW

SEQ ID NO: 3714 - protein, 9 aa, Homo Sapiens
AVAELARKA

SEQ ID NO: 3715 - protein, 9 aa, Homo Sapiens
WIQDEMELG

SEQ ID NO: 3716 - protein, 9 aa, Homo Sapiens
ELGYVQAPH

SEQ ID NO: 3717 - protein, 9 aa, Homo Sapiens
VVFDSPRNG

SEQ ID NO: 3718 - protein, 9 aa, Homo Sapiens
SGLDSFGNL

SEQ ID NO: 3719 - protein, 9 aa, Homo Sapiens
QVVRDFLHA

SEQ ID NO: 3720 - protein, 9 aa, Homo Sapiens
KDLINYNKF

SEQ ID NO: 3721 - protein, 9 aa, Homo Sapiens
FVQSCIDWN

SEQ ID NO: 3722 - protein, 9 aa, Homo Sapiens
DFTPYHMLH

SEQ ID NO: 3723 - protein, 9 aa, Homo Sapiens
TLVDIYGSV

SEQ ID NO: 3724 - protein, 9 aa, Homo Sapiens
EMFEVYGTP

SEQ ID NO: 3725 - protein, 9 aa, Homo Sapiens
TLEIIVVMN

SEQ ID NO: 3726 - protein, 9 aa, Homo Sapiens
SHEPLPLAY

SEQ ID NO: 3727 - protein, 9 aa, Homo Sapiens
NCDQHVHCL

SEQ ID NO: 3728 - protein, 9 aa, Homo Sapiens
FPDAGFTGL

SEQ ID NO: 3729 - protein, 9 aa, Homo Sapiens
GFTGLISFH

SEQ ID NO: 3730 - protein, 9 aa, Homo Sapiens
DSNEDFSAS

SEQ ID NO: 3731 - protein, 9 aa, Homo Sapiens
VFRVAPWIM

SEQ ID NO: 3732 - protein, 9 aa, Homo Sapiens
LTICPQAEN

SEQ ID NO: 3733 - protein, 9 aa, Homo Sapiens
TICPQAENR

SEQ ID NO: 3734 - protein, 9 aa, Homo Sapiens
IQDEMELGY

SEQ ID NO: 3735 - protein, 9 aa, Homo Sapiens
TLPVVFDSP

SEQ ID NO: 3736 - protein, 9 aa, Homo Sapiens
DFPYKRILG

SEQ ID NO: 3737 - protein, 9 aa, Homo Sapiens
ILGPDFGYV

SEQ ID NO: 3738 - protein, 9 aa, Homo Sapiens
SVSGLDSFG

SEQ ID NO: 3739 - protein, 9 aa, Homo Sapiens
DSFGNLEVS

SEQ ID NO: 3740 - protein, 9 aa, Homo Sapiens
FVDWLAVGH

SEQ ID NO: 3741 - protein, 9 aa, Homo Sapiens
DEFLSFVPA

SEQ ID NO: 3742 - protein, 9 aa, Homo Sapiens
VPAPDGKGF

SEQ ID NO: 3743 - protein, 9 aa, Homo Sapiens
PDGKGFRML

SEQ ID NO: 3744 - protein, 9 aa, Homo Sapiens
SPGACFKLF

SEQ ID NO: 3745 - protein, 9 aa, Homo Sapiens
VVDDEQVKT

SEQ ID NO: 3746 - protein, 9 aa, Homo Sapiens
ELGLAECDI

SEQ ID NO: 3747 - protein, 9 aa, Homo Sapiens
LVLGKHLGI

SEQ ID NO: 3748 - protein, 9 aa, Homo Sapiens
SLLEPLGLH

SEQ ID NO: 3749 - protein, 9 aa, Homo Sapiens
LHCTFIDDF

SEQ ID NO: 3750 - protein, 9 aa, Homo Sapiens
MLHGEVHCG

SEQ ID NO: 3751 - protein, 9 aa, Homo Sapiens
CVAGVETLV

SEQ ID NO: 3752 - protein, 9 aa, Homo Sapiens
GTPGVDIYI

SEQ ID NO: 3753 - protein, 9 aa, Homo Sapiens
VVMNSPSND

SEQ ID NO: 3754 - protein, 9 aa, Homo Sapiens
SLDCDLNCE

SEQ ID NO: 3755 - protein, 9 aa, Homo Sapiens
QHVHCLQDL

SEQ ID NO: 3756 - protein, 9 aa, Homo Sapiens
HCLQDLEDM

SEQ ID NO: 3757 - protein, 9 aa, Homo Sapiens
DDHKLVLHT

SEQ ID NO: 3758 - protein, 9 aa, Homo Sapiens
HTSSYDAKR

SEQ ID NO: 3759 - protein, 9 aa, Homo Sapiens
YDAKRAQVF

SEQ ID NO: 3760 - protein, 9 aa, Homo Sapiens
HVLGQDKVS

SEQ ID NO: 3761 - protein, 9 aa, Homo Sapiens
FFVEGLSFP

SEQ ID NO: 3762 - protein, 9 aa, Homo Sapiens
FVEGLSFPD

SEQ ID NO: 3763 - protein, 9 aa, Homo Sapiens
DFSASPIFT

SEQ ID NO: 3764 - protein, 9 aa, Homo Sapiens
VVFRVAPWI

SEQ ID NO: 3765 - protein, 9 aa, Homo Sapiens
TLPPLEVYV

SEQ ID NO: 3766 - protein, 9 aa, Homo Sapiens
PLEVYVCRV

SEQ ID NO: 3767 - protein, 9 aa, Homo Sapiens
RWIQDEMEL

SEQ ID NO: 3768 - protein, 9 aa, Homo Sapiens
PHKTLPVVF

SEQ ID NO: 3769 - protein, 9 aa, Homo Sapiens
DFGYVTREP

SEQ ID NO: 3770 - protein, 9 aa, Homo Sapiens
VTREPRDRS

SEQ ID NO: 3771 - protein, 9 aa, Homo Sapiens
PLGRILIGG

SEQ ID NO: 3772 - protein, 9 aa, Homo Sapiens
NLPGSSGRR

SEQ ID NO: 3773 - protein, 9 aa, Homo Sapiens
APDGKGFRM

SEQ ID NO: 3774 - protein, 9 aa, Homo Sapiens
GFRMLLASP

SEQ ID NO: 3775 - protein, 9 aa, Homo Sapiens
KLFQEKQKC

SEQ ID NO: 3776 - protein, 9 aa, Homo Sapiens
VLKRELGLA

SEQ ID NO: 3777 - protein, 9 aa, Homo Sapiens
TERKKATAF

SEQ ID NO: 3778 - protein, 9 aa, Homo Sapiens
KATAFFPDL

SEQ ID NO: 3779 - protein, 9 aa, Homo Sapiens
VLGKHLGIP

SEQ ID NO: 3780 - protein, 9 aa, Homo Sapiens
PFGPIINGC

SEQ ID NO: 3781 - protein, 9 aa, Homo Sapiens
FIDDFTPYH

SEQ ID NO: 3782 - protein, 9 aa, Homo Sapiens
SLQRIVRVS

SEQ ID NO: 3783 - protein, 9 aa, Homo Sapiens
PTSAVCVAG

SEQ ID NO: 3784 - protein, 9 aa, Homo Sapiens
AVCVAGVET

SEQ ID NO: 3785 - protein, 9 aa, Homo Sapiens
VCVAGVETL

SEQ ID NO: 3786 - protein, 9 aa, Homo Sapiens
LVDIYGSVP

SEQ ID NO: 3787 - protein, 9 aa, Homo Sapiens
VDIYISPNM

SEQ ID NO: 3788 - protein, 9 aa, Homo Sapiens
RADTRRWRF

SEQ ID NO: 3789 - protein, 9 aa, Homo Sapiens
IVVMNSPSN

SEQ ID NO: 3790 - protein, 9 aa, Homo Sapiens
DSHVQISYH

SEQ ID NO: 3791 - protein, 9 aa, Homo Sapiens
QISYHSSHE

SEQ ID NO: 3792 - protein, 9 aa, Homo Sapiens
VDISLDCDL

SEQ ID NO: 3793 - protein, 9 aa, Homo Sapiens
CEGRQDRNF

SEQ ID NO: 3794 - protein, 9 aa, Homo Sapiens
FVDKRQWVW

SEQ ID NO: 3795 - protein, 9 aa, Homo Sapiens
DKRQWVWGP

SEQ ID NO: 3796 - protein, 9 aa, Homo Sapiens
QWVWGPSGY

SEQ ID NO: 3797 - protein, 9 aa, Homo Sapiens
WVWGPSGYG

SEQ ID NO: 3798 - protein, 9 aa, Homo Sapiens
EDMSVMVLR

SEQ ID NO: 3799 - protein, 9 aa, Homo Sapiens
SVMVLRTQG

SEQ ID NO: 3800 - protein, 9 aa, Homo Sapiens
QVFHICGPE

SEQ ID NO: 3801 - protein, 9 aa, Homo Sapiens
HICGPEDVC

SEQ ID NO: 3802 - protein, 9 aa, Homo Sapiens
GPEDVCEAY

SEQ ID NO: 3803 - protein, 9 aa, Homo Sapiens
DEERFFVEG

SEQ ID NO: 3804 - protein, 9 aa, Homo Sapiens
HVTLLDDSN

SEQ ID NO: 3805 - protein, 9 aa, Homo Sapiens
VTLLDDSNE

SEQ ID NO: 3806 - protein, 9 aa, Homo Sapiens
IFTDTVVFR

SEQ ID NO: 3807 - protein, 9 aa, Homo Sapiens
DAVAELARK

SEQ ID NO: 3808 - protein, 9 aa, Homo Sapiens
EMELGYVQA

SEQ ID NO: 3809 - protein, 9 aa, Homo Sapiens
PVVFDSPRN

SEQ ID NO: 3810 - protein, 9 aa, Homo Sapiens
QDFPYKRIL

SEQ ID NO: 3811 - protein, 9 aa, Homo Sapiens
YKRILGPDF

SEQ ID NO: 3812 - protein, 9 aa, Homo Sapiens
ILIGGNLPG

SEQ ID NO: 3813 - protein, 9 aa, Homo Sapiens
DFLHAQKVQ

SEQ ID NO: 3814 - protein, 9 aa, Homo Sapiens
LFVDWLAVG

SEQ ID NO: 3815 - protein, 9 aa, Homo Sapiens
FVPAPDGKG

SEQ ID NO: 3816 - protein, 9 aa, Homo Sapiens
ASPGACFKL

SEQ ID NO: 3817 - protein, 9 aa, Homo Sapiens
CGHGRALLF

SEQ ID NO: 3818 - protein, 9 aa, Homo Sapiens
LFQGVVDDE

SEQ ID NO: 3819 - protein, 9 aa, Homo Sapiens
GVVDDEQVK

SEQ ID NO: 3820 - protein, 9 aa, Homo Sapiens
EQVKTISIN

SEQ ID NO: 3821 - protein, 9 aa, Homo Sapiens
QVKTISINQ

SEQ ID NO: 3822 - protein, 9 aa, Homo Sapiens
QLFKTERKK

SEQ ID NO: 3823 - protein, 9 aa, Homo Sapiens
KTERKKATA

SEQ ID NO: 3824 - protein, 9 aa, Homo Sapiens
PDLVNMLVL

SEQ ID NO: 3825 - protein, 9 aa, Homo Sapiens
KHLGIPKPF

SEQ ID NO: 3826 - protein, 9 aa, Homo Sapiens
IINGCCCLE

SEQ ID NO: 3827 - protein, 9 aa, Homo Sapiens
EKVRSLLEP

SEQ ID NO: 3828 - protein, 9 aa, Homo Sapiens
LLEPLGLHC

SEQ ID NO: 3829 - protein, 9 aa, Homo Sapiens
GLHCTFIDD

SEQ ID NO: 3830 - protein, 9 aa, Homo Sapiens
CTFIDDFTP

SEQ ID NO: 3831 - protein, 9 aa, Homo Sapiens
RIVRVSLEH

SEQ ID NO: 3832 - protein, 9 aa, Homo Sapiens
RVSLEHPTS

SEQ ID NO: 3833 - protein, 9 aa, Homo Sapiens
GSVPEGTEM

SEQ ID NO: 3834 - protein, 9 aa, Homo Sapiens
GTEMFEVYG

SEQ ID NO: 3835 - protein, 9 aa, Homo Sapiens
RFDATLEII

SEQ ID NO: 3836 - protein, 9 aa, Homo Sapiens
IIVVMNSPS

SEQ ID NO: 3837 - protein, 9 aa, Homo Sapiens
NDSHVQISY

SEQ ID NO: 3838 - protein, 9 aa, Homo Sapiens
LPLAYAVLY

SEQ ID NO: 3839 - protein, 9 aa, Homo Sapiens
AVLYLTCVD

SEQ ID NO: 3840 - protein, 9 aa, Homo Sapiens
DPSCDVQDN

SEQ ID NO: 3841 - protein, 9 aa, Homo Sapiens
HVHCLQDLE

SEQ ID NO: 3842 - protein, 9 aa, Homo Sapiens
CLQDLEDMS

SEQ ID NO: 3843 - protein, 9 aa, Homo Sapiens
DMSVMVLRT

SEQ ID NO: 3844 - protein, 9 aa, Homo Sapiens
VLRTQGPAA

SEQ ID NO: 3845 - protein, 9 aa, Homo Sapiens
LRTQGPAAL

SEQ ID NO: 3846 - protein, 9 aa, Homo Sapiens
ALFDDHKLV

SEQ ID NO: 3847 - protein, 9 aa, Homo Sapiens
DHKLVLHTS

SEQ ID NO: 3848 - protein, 9 aa, Homo Sapiens
LVLHTSSYD

SEQ ID NO: 3849 - protein, 9 aa, Homo Sapiens
EAYRHVLGQ

SEQ ID NO: 3850 - protein, 9 aa, Homo Sapiens
LHGDEERFF

SEQ ID NO: 3851 - protein, 9 aa, Homo Sapiens
FTGLISFHV

SEQ ID NO: 3852 - protein, 9 aa, Homo Sapiens
PWIMTPSTL

SEQ ID NO: 3853 - protein, 9 aa, Homo Sapiens
YVCRVRNNT

SEQ ID NO: 3854 - protein, 9 aa, Homo Sapiens
NTCFVDAVA

SEQ ID NO: 3855 - protein, 9 aa, Homo Sapiens
FVDAVAELA

SEQ ID NO: 3856 - protein, 9 aa, Homo Sapiens
FDSPRNGEL

SEQ ID NO: 3857 - protein, 9 aa, Homo Sapiens
NGELQDFPY

SEQ ID NO: 3858 - protein, 9 aa, Homo Sapiens
VVANGKEYP

SEQ ID NO: 3859 - protein, 9 aa, Homo Sapiens
VANGKEYPL

SEQ ID NO: 3860 - protein, 9 aa, Homo Sapiens
KEYPLGRIL

SEQ ID NO: 3861 - protein, 9 aa, Homo Sapiens
GRILIGGNL

SEQ ID NO: 3862 - protein, 9 aa, Homo Sapiens
FLHAQKVQP

SEQ ID NO: 3863 - protein, 9 aa, Homo Sapiens
QKVQPPVEL

SEQ ID NO: 3864 - protein, 9 aa, Homo Sapiens
QKCGHGRAL

SEQ ID NO: 3865 - protein, 9 aa, Homo Sapiens
TISINQVLS

SEQ ID NO: 3866 - protein, 9 aa, Homo Sapiens
QVLSNKDLI

SEQ ID NO: 3867 - protein, 9 aa, Homo Sapiens
DWNREVLKR

SEQ ID NO: 3868 - protein, 9 aa, Homo Sapiens
GLAECDIID

SEQ ID NO: 3869 - protein, 9 aa, Homo Sapiens
IIDIPQLFK

SEQ ID NO: 3870 - protein, 9 aa, Homo Sapiens
ATAFFPDLV

SEQ ID NO: 3871 - protein, 9 aa, Homo Sapiens
LQRIVRVSL

SEQ ID NO: 3872 - protein, 9 aa, Homo Sapiens
SLEHPTSAV

SEQ ID NO: 3873 - protein, 9 aa, Homo Sapiens
DATLEIIVV

SEQ ID NO: 3874 - protein, 9 aa, Homo Sapiens
SYHSSHEPL

SEQ ID NO: 3875 - protein, 9 aa, Homo Sapiens
EPLPLAYAV

SEQ ID NO: 3876 - protein, 9 aa, Homo Sapiens
GPSGYGGIL

SEQ ID NO: 3877 - protein, 9 aa, Homo Sapiens
GILLVNCDR

SEQ ID NO: 3878 - protein, 9 aa, Homo Sapiens
LVNCDRDDP

SEQ ID NO: 3879 - protein, 9 aa, Homo Sapiens
DDPSCDVQD

SEQ ID NO: 3880 - protein, 9 aa, Homo Sapiens
DNCDQHVHC

SEQ ID NO: 3881 - protein, 9 aa, Homo Sapiens
MVLRTQGPA

SEQ ID NO: 3882 - protein, 9 aa, Homo Sapiens
SFHVTLLDD

SEQ ID NO: 3883 - protein, 9 aa, Homo Sapiens
TLLDDSNED

SEQ ID NO: 3884 - protein, 9 aa, Homo Sapiens
WIMTPSTLP

SEQ ID NO: 3885 - protein, 9 aa, Homo Sapiens
CRVRNNTCF

SEQ ID NO: 3886 - protein, 9 aa, Homo Sapiens
RVRNNTCFV

SEQ ID NO: 3887 - protein, 9 aa, Homo Sapiens
LARKAGCKL

SEQ ID NO: 3888 - protein, 9 aa, Homo Sapiens
KLTICPQAE

SEQ ID NO: 3889 - protein, 9 aa, Homo Sapiens
YVTREPRDR

SEQ ID NO: 3890 - protein, 9 aa, Homo Sapiens
GLDSFGNLE

SEQ ID NO: 3891 - protein, 9 aa, Homo Sapiens
NLEVSPPVV

SEQ ID NO: 3892 - protein, 9 aa, Homo Sapiens
RILIGGNLP

SEQ ID NO: 3893 - protein, 9 aa, Homo Sapiens
WLAVGHVDE

SEQ ID NO: 3894 - protein, 9 aa, Homo Sapiens
MLLASPGAC

SEQ ID NO: 3895 - protein, 9 aa, Homo Sapiens
ACFKLFQEK

SEQ ID NO: 3896 - protein, 9 aa, Homo Sapiens
ALLFQGVVD

SEQ ID NO: 3897 - protein, 9 aa, Homo Sapiens
LINYNKFVQ

SEQ ID NO: 3898 - protein, 9 aa, Homo Sapiens
NREVLKREL

SEQ ID NO: 3899 - protein, 9 aa, Homo Sapiens
IDIPQLFKT

SEQ ID NO: 3900 - protein, 9 aa, Homo Sapiens
NMLVLGKHL

SEQ ID NO: 3901 - protein, 9 aa, Homo Sapiens
LEEKVRSLL

SEQ ID NO: 3902 - protein, 9 aa, Homo Sapiens
IDDFTPYHM

SEQ ID NO: 3903 - protein, 9 aa, Homo Sapiens
EHPTSAVCV

SEQ ID NO: 3904 - protein, 9 aa, Homo Sapiens
RRWRFDATL

SEQ ID NO: 3905 - protein, 9 aa, Homo Sapiens
VMNSPSNDL

SEQ ID NO: 3906 - protein, 9 aa, Homo Sapiens
VLYLTCVDI

SEQ ID NO: 3907 - protein, 9 aa, Homo Sapiens
NFVDKRQWV

SEQ ID NO: 3908 - protein, 9 aa, Homo Sapiens
ILLVNCDRD

SEQ ID NO: 3909 - protein, 9 aa, Homo Sapiens
AALFDDHKL

SEQ ID NO: 3910 - protein, 9 aa, Homo Sapiens
VLHTSSYDA

SEQ ID NO: 3911 - protein, 9 aa, Homo Sapiens
NDRWIQDEM

SEQ ID NO: 3912 - protein, 9 aa, Homo Sapiens
DEMELGYVQ

SEQ ID NO: 3913 - protein, 9 aa, Homo Sapiens
VFDSPRNGE

SEQ ID NO: 3914 - protein, 9 aa, Homo Sapiens
PDFGYVTRE

SEQ ID NO: 3915 - protein, 9 aa, Homo Sapiens
EPRDRSVSG

SEQ ID NO: 3916 - protein, 9 aa, Homo Sapiens
SFGNLEVSP

SEQ ID NO: 3917 - protein, 9 aa, Homo Sapiens
VSPPVVANG

SEQ ID NO: 3918 - protein, 9 aa, Homo Sapiens
FLSFVPAPD

SEQ ID NO: 3919 - protein, 9 aa, Homo Sapiens
SFVPAPDGK

SEQ ID NO: 3920 - protein, 9 aa, Homo Sapiens
LFQEKQKCG

SEQ ID NO: 3921 - protein, 9 aa, Homo Sapiens
KCGHGRALL

SEQ ID NO: 3922 - protein, 9 aa, Homo Sapiens
NQVLSNKDL

SEQ ID NO: 3923 - protein, 9 aa, Homo Sapiens
VLSNKDLIN

SEQ ID NO: 3924 - protein, 9 aa, Homo Sapiens
HLGIPKPFG

SEQ ID NO: 3925 - protein, 9 aa, Homo Sapiens
KPFGPIING

SEQ ID NO: 3926 - protein, 9 aa, Homo Sapiens
RSLLEPLGL

SEQ ID NO: 3927 - protein, 9 aa, Homo Sapiens
ERADTRRWR

SEQ ID NO: 3928 - protein, 9 aa, Homo Sapiens
LEIIVVMNS

SEQ ID NO: 3929 - protein, 9 aa, Homo Sapiens
HSSHEPLPL

SEQ ID NO: 3930 - protein, 9 aa, Homo Sapiens
DCDLNCEGR

SEQ ID NO: 3931 - protein, 9 aa, Homo Sapiens
PSGYGGILL

SEQ ID NO: 3932 - protein, 9 aa, Homo Sapiens
LLVNCDRDD

SEQ ID NO: 3933 - protein, 9 aa, Homo Sapiens
DRDDPSCDV

SEQ ID NO: 3934 - protein, 9 aa, Homo Sapiens
DAKRAQVFH

SEQ ID NO: 3935 - protein, 9 aa, Homo Sapiens
VFHICGPED

SEQ ID NO: 3936 - protein, 9 aa, Homo Sapiens
CGPEDVCEA

SEQ ID NO: 3937 - protein, 9 aa, Homo Sapiens
VCEAYRHVL

SEQ ID NO: 3938 - protein, 9 aa, Homo Sapiens
DKVSYEVPR

SEQ ID NO: 3939 - protein, 9 aa, Homo Sapiens
ERFFVEGLS

SEQ ID NO: 3940 - protein, 9 aa, Homo Sapiens
EGLSFPDAG

SEQ ID NO: 3941 - protein, 9 aa, Homo Sapiens
SFPDAGFTG

SEQ ID NO: 3942 - protein, 9 aa, Homo Sapiens
DRWIQDEME

SEQ ID NO: 3943 - protein, 9 aa, Homo Sapiens
MELGYVQAP

SEQ ID NO: 3944 - protein, 9 aa, Homo Sapiens
LHAQKVQPP

SEQ ID NO: 3945 - protein, 9 aa, Homo Sapiens
PPVELFVDW

SEQ ID NO: 3946 - protein, 9 aa, Homo Sapiens
CFKLFQEKQ

SEQ ID NO: 3947 - protein, 9 aa, Homo Sapiens
EKQKCGHGR

SEQ ID NO: 3948 - protein, 9 aa, Homo Sapiens
GRALLFQGV

SEQ ID NO: 3949 - protein, 9 aa, Homo Sapiens
VDDEQVKTI

SEQ ID NO: 3950 - protein, 9 aa, Homo Sapiens
DEQVKTISI

SEQ ID NO: 3951 - protein, 9 aa, Homo Sapiens
ISINQVLSN

SEQ ID NO: 3952 - protein, 9 aa, Homo Sapiens
KFVQSCIDW

SEQ ID NO: 3953 - protein, 9 aa, Homo Sapiens
LFKTERKKA

SEQ ID NO: 3954 - protein, 9 aa, Homo Sapiens
MLVLGKHLG

SEQ ID NO: 3955 - protein, 9 aa, Homo Sapiens
PLGLHCTFI

SEQ ID NO: 3956 - protein, 9 aa, Homo Sapiens
SFKWWNMVP

SEQ ID NO: 3957 - protein, 9 aa, Homo Sapiens
MSLQRIVRV

SEQ ID NO: 3958 - protein, 9 aa, Homo Sapiens
QRIVRVSLE

SEQ ID NO: 3959 - protein, 9 aa, Homo Sapiens
TSAVCVAGV

SEQ ID NO: 3960 - protein, 9 aa, Homo Sapiens
AGVETLVDI

SEQ ID NO: 3961 - protein, 9 aa, Homo Sapiens
ERGRERADT

SEQ ID NO: 3962 - protein, 9 aa, Homo Sapiens
LNDSHVQIS

SEQ ID NO: 3963 - protein, 9 aa, Homo Sapiens
SSHEPLPLA

SEQ ID NO: 3964 - protein, 9 aa, Homo Sapiens
EGRQDRNFV

SEQ ID NO: 3965 - protein, 9 aa, Homo Sapiens
DRNFVDKRQ

SEQ ID NO: 3966 - protein, 9 aa, Homo Sapiens
WGPSGYGGI

SEQ ID NO: 3967 - protein, 9 aa, Homo Sapiens
YGGILLVNC

SEQ ID NO: 3968 - protein, 9 aa, Homo Sapiens
GGILLVNCD

SEQ ID NO: 3969 - protein, 9 aa, Homo Sapiens
DQHVHCLQD

SEQ ID NO: 3970 - protein, 9 aa, Homo Sapiens
FDDHKLVLH

SEQ ID NO: 3971 - protein, 9 aa, Homo Sapiens
LHTSSYDAK

SEQ ID NO: 3972 - protein, 9 aa, Homo Sapiens
EDVCEAYRH

SEQ ID NO: 3973 - protein, 9 aa, Homo Sapiens
LGQDKVSYE

SEQ ID NO: 3974 - protein, 9 aa, Homo Sapiens
YEVPRLHGD

SEQ ID NO: 3975 - protein, 9 aa, Homo Sapiens
DDSNEDFSA

SEQ ID NO: 3976 - protein, 9 aa, Homo Sapiens
PPLEVYVCR

SEQ ID NO: 3977 - protein, 9 aa, Homo Sapiens
DSPRNGELQ

SEQ ID NO: 3978 - protein, 9 aa, Homo Sapiens
DRSVSGLDS

SEQ ID NO: 3979 - protein, 9 aa, Homo Sapiens
EYPLGRILI

SEQ ID NO: 3980 - protein, 9 aa, Homo Sapiens
RRVTQVVRD

SEQ ID NO: 3981 - protein, 9 aa, Homo Sapiens
KGFRMLLAS

SEQ ID NO: 3982 - protein, 9 aa, Homo Sapiens
DDEQVKTIS

SEQ ID NO: 3983 - protein, 9 aa, Homo Sapiens
SNKDLINYN

SEQ ID NO: 3984 - protein, 9 aa, Homo Sapiens
INYNKFVQS

SEQ ID NO: 3985 - protein, 9 aa, Homo Sapiens
NYNKFVQSC

SEQ ID NO: 3986 - protein, 9 aa, Homo Sapiens
WNREVLKRE

SEQ ID NO: 3987 - protein, 9 aa, Homo Sapiens
ECDIIDIPQ

SEQ ID NO: 3988 - protein, 9 aa, Homo Sapiens
EEKVRSLLE

SEQ ID NO: 3989 - protein, 9 aa, Homo Sapiens
MFEVYGTPG

SEQ ID NO: 3990 - protein, 9 aa, Homo Sapiens
PGVDIYISP

SEQ ID NO: 3991 - protein, 9 aa, Homo Sapiens
HEPLPLAYA

SEQ ID NO: 3992 - protein, 9 aa, Homo Sapiens
AYAVLYLTC

SEQ ID NO: 3993 - protein, 9 aa, Homo Sapiens
RQDRNFVDK

SEQ ID NO: 3994 - protein, 9 aa, Homo Sapiens
SGYGGILLV

SEQ ID NO: 3995 - protein, 9 aa, Homo Sapiens
GYGGILLVN

SEQ ID NO: 3996 - protein, 9 aa, Homo Sapiens
GPAALFDDH

SEQ ID NO: 3997 - protein, 9 aa, Homo Sapiens
AKRAQVFHI

SEQ ID NO: 3998 - protein, 9 aa, Homo Sapiens
KRAQVFHIC

SEQ ID NO: 3999 - protein, 9 aa, Homo Sapiens
QDKVSYEVP

SEQ ID NO: 4000 - protein, 9 aa, Homo Sapiens
GDEERFFVE

SEQ ID NO: 4001 - protein, 9 aa, Homo Sapiens
VEGLSFPDA

SEQ ID NO: 4002 - protein, 9 aa, Homo Sapiens
DAGFTGLIS

SEQ ID NO: 4003 - protein, 9 aa, Homo Sapiens
FSASPIFTD

SEQ ID NO: 4004 - protein, 9 aa, Homo Sapiens
SASPIFTDT

SEQ ID NO: 4005 - protein, 9 aa, Homo Sapiens
ENRNDRWIQ

SEQ ID NO: 4006 - protein, 9 aa, Homo Sapiens
RNDRWIQDE

SEQ ID NO: 4007 - protein, 9 aa, Homo Sapiens
APHKTLPVV

SEQ ID NO: 4008 - protein, 9 aa, Homo Sapiens
GELQDFPYK

SEQ ID NO: 4009 - protein, 9 aa, Homo Sapiens
LQDFPYKRI

SEQ ID NO: 4010 - protein, 9 aa, Homo Sapiens
FPYKRILGP

SEQ ID NO: 4011 - protein, 9 aa, Homo Sapiens
GPDFGYVTR

SEQ ID NO: 4012 - protein, 9 aa, Homo Sapiens
ANGKEYPLG

SEQ ID NO: 4013 - protein, 9 aa, Homo Sapiens
YPLGRILIG

SEQ ID NO: 4014 - protein, 9 aa, Homo Sapiens
LGRILIGGN

SEQ ID NO: 4015 - protein, 9 aa, Homo Sapiens
DWLAVGHVD

SEQ ID NO: 4016 - protein, 9 aa, Homo Sapiens
GACFKLFQE

SEQ ID NO: 4017 - protein, 9 aa, Homo Sapiens
HGRALLFQG

SEQ ID NO: 4018 - protein, 9 aa, Homo Sapiens
VKTISINQV

SEQ ID NO: 4019 - protein, 9 aa, Homo Sapiens
KRELGLAEC

SEQ ID NO: 4020 - protein, 9 aa, Homo Sapiens
GKHLGIPKP

SEQ ID NO: 4021 - protein, 9 aa, Homo Sapiens
LGIPKPFGP

SEQ ID NO: 4022 - protein, 9 aa, Homo Sapiens
VCRKPFSFK

SEQ ID NO: 4023 - protein, 9 aa, Homo Sapiens
RKPFSFKWW

SEQ ID NO: 4024 - protein, 9 aa, Homo Sapiens
HPTSAVCVA

SEQ ID NO: 4025 - protein, 9 aa, Homo Sapiens
PEGTEMFEV

SEQ ID NO: 4026 - protein, 9 aa, Homo Sapiens
TEMFEVYGT

SEQ ID NO: 4027 - protein, 9 aa, Homo Sapiens
IYISPNMER

SEQ ID NO: 4028 - protein, 9 aa, Homo Sapiens
TRRWRFDAT

SEQ ID NO: 4029 - protein, 9 aa, Homo Sapiens
VQISYHSSH

SEQ ID NO: 4030 - protein, 9 aa, Homo Sapiens
QDRNFVDKR

SEQ ID NO: 4031 - protein, 9 aa, Homo Sapiens
QGPAALFDD

SEQ ID NO: 4032 - protein, 9 aa, Homo Sapiens
AQVFHICGP

SEQ ID NO: 4033 - protein, 9 aa, Homo Sapiens
AYRHVLGQD

SEQ ID NO: 4034 - protein, 9 aa, Homo Sapiens
TGLISFHVT

SEQ ID NO: 4035 - protein, 9 aa, Homo Sapiens
FHVTLLDDS

SEQ ID NO: 4036 - protein, 9 aa, Homo Sapiens
VAPWIMTPS

SEQ ID NO: 4037 - protein, 9 aa, Homo Sapiens
LPPLEVYVC

SEQ ID NO: 4038 - protein, 9 aa, Homo Sapiens
VYVCRVRNN

SEQ ID NO: 4039 - protein, 9 aa, Homo Sapiens
RNNTCFVDA

SEQ ID NO: 4040 - protein, 9 aa, Homo Sapiens
NNTCFVDAV

SEQ ID NO: 4041 - protein, 9 aa, Homo Sapiens
KAGCKLTIC

SEQ ID NO: 4042 - protein, 9 aa, Homo Sapiens
GCKLTICPQ

SEQ ID NO: 4043 - protein, 9 aa, Homo Sapiens
HKTLPVVFD

SEQ ID NO: 4044 - protein, 9 aa, Homo Sapiens
PYKRILGPD

SEQ ID NO: 4045 - protein, 9 aa, Homo Sapiens
FGNLEVSPP

SEQ ID NO: 4046 - protein, 9 aa, Homo Sapiens
GKEYPLGRI

SEQ ID NO: 4047 - protein, 9 aa, Homo Sapiens
SSGRRVTQV

SEQ ID NO: 4048 - protein, 9 aa, Homo Sapiens
QPPVELFVD

SEQ ID NO: 4049 - protein, 9 aa, Homo Sapiens
VDWLAVGHV

SEQ ID NO: 4050 - protein, 9 aa, Homo Sapiens
AECDIIDIP

SEQ ID NO: 4051 - protein, 9 aa, Homo Sapiens
KKATAFFPD

SEQ ID NO: 4052 - protein, 9 aa, Homo Sapiens
VNMLVLGKH

SEQ ID NO: 4053 - protein, 9 aa, Homo Sapiens
NGCCCLEEK

SEQ ID NO: 4054 - protein, 9 aa, Homo Sapiens
LEPLGLHCT

SEQ ID NO: 4055 - protein, 9 aa, Homo Sapiens
TPYHMLHGE

SEQ ID NO: 4056 - protein, 9 aa, Homo Sapiens
HCGTNVCRK

SEQ ID NO: 4057 - protein, 9 aa, Homo Sapiens
TPGVDIYIS

SEQ ID NO: 4058 - protein, 9 aa, Homo Sapiens
WRFDATLEI

SEQ ID NO: 4059 - protein, 9 aa, Homo Sapiens
SPSNDLNDS

SEQ ID NO: 4060 - protein, 9 aa, Homo Sapiens
LAYAVLYLT

SEQ ID NO: 4061 - protein, 9 aa, Homo Sapiens
YAVLYLTCV

SEQ ID NO: 4062 - protein, 9 aa, Homo Sapiens
LYLTCVDIS

SEQ ID NO: 4063 - protein, 9 aa, Homo Sapiens
VWGPSGYGG

SEQ ID NO: 4064 - protein, 9 aa, Homo Sapiens
RDDPSCDVQ

SEQ ID NO: 4065 - protein, 9 aa, Homo Sapiens
MSVMVLRTQ

SEQ ID NO: 4066 - protein, 9 aa, Homo Sapiens
SYDAKRAQV

SEQ ID NO: 4067 - protein, 9 aa, Homo Sapiens
LSFPDAGFT

SEQ ID NO: 4068 - protein, 9 aa, Homo Sapiens
TDTVVFRVA

SEQ ID NO: 4069 - protein, 9 aa, Homo Sapiens
TCFVDAVAE

SEQ ID NO: 4070 - protein, 9 aa, Homo Sapiens
QDEMELGYV

SEQ ID NO: 4071 - protein, 9 aa, Homo Sapiens
NGKEYPLGR

SEQ ID NO: 4072 - protein, 9 aa, Homo Sapiens
GNLPGSSGR

SEQ ID NO: 4073 - protein, 9 aa, Homo Sapiens
VRDFLHAQK

SEQ ID NO: 4074 - protein, 9 aa, Homo Sapiens
RDFLHAQKV

SEQ ID NO: 4075 - protein, 9 aa, Homo Sapiens
GKGFRMLLA

SEQ ID NO: 4076 - protein, 9 aa, Homo Sapiens
QEKQKCGHG

SEQ ID NO: 4077 - protein, 9 aa, Homo Sapiens
GHGRALLFQ

SEQ ID NO: 4078 - protein, 9 aa, Homo Sapiens
SCIDWNREV

SEQ ID NO: 4079 - protein, 9 aa, Homo Sapiens
LKRELGLAE

SEQ ID NO: 4080 - protein, 9 aa, Homo Sapiens
LAECDIIDI

SEQ ID NO: 4081 - protein, 9 aa, Homo Sapiens
IPKPFGPII

SEQ ID NO: 4082 - protein, 9 aa, Homo Sapiens
CCLEEKVRS

SEQ ID NO: 4083 - protein, 9 aa, Homo Sapiens
CRKPFSFKW

SEQ ID NO: 4084 - protein, 9 aa, Homo Sapiens
FSFKWWNMV

SEQ ID NO: 4085 - protein, 9 aa, Homo Sapiens
VSLEHPTSA

SEQ ID NO: 4086 - protein, 9 aa, Homo Sapiens
LEHPTSAVC

SEQ ID NO: 4087 - protein, 9 aa, Homo Sapiens
VDIYGSVPE

SEQ ID NO: 4088 - protein, 9 aa, Homo Sapiens
VPEGTEMFE

SEQ ID NO: 4089 - protein, 9 aa, Homo Sapiens
PNMERGRER

SEQ ID NO: 4090 - protein, 9 aa, Homo Sapiens
MERGRERAD

SEQ ID NO: 4091 - protein, 9 aa, Homo Sapiens
MNSPSNDLN

SEQ ID NO: 4092 - protein, 9 aa, Homo Sapiens
NSPSNDLND

SEQ ID NO: 4093 - protein, 9 aa, Homo Sapiens
PSNDLNDSH

SEQ ID NO: 4094 - protein, 9 aa, Homo Sapiens
SNDLNDSHV

SEQ ID NO: 4095 - protein, 9 aa, Homo Sapiens
LDCDLNCEG

SEQ ID NO: 4096 - protein, 9 aa, Homo Sapiens
LNCEGRQDR

SEQ ID NO: 4097 - protein, 9 aa, Homo Sapiens
NCEGRQDRN

SEQ ID NO: 4098 - protein, 9 aa, Homo Sapiens
RNFVDKRQW

SEQ ID NO: 4099 - protein, 9 aa, Homo Sapiens
VDKRQWVWG

SEQ ID NO: 4100 - protein, 9 aa, Homo Sapiens
NCDRDDPSC

SEQ ID NO: 4101 - protein, 9 aa, Homo Sapiens
VQDNCDQHV

SEQ ID NO: 4102 - protein, 9 aa, Homo Sapiens
LQDLEDMSV

SEQ ID NO: 4103 - protein, 9 aa, Homo Sapiens
ICGPEDVCE

SEQ ID NO: 4104 - protein, 9 aa, Homo Sapiens
GQDKVSYEV

SEQ ID NO: 4105 - protein, 9 aa, Homo Sapiens
HGDEERFFV

SEQ ID NO: 4106 - protein, 9 aa, Homo Sapiens
PDAGFTGLI

SEQ ID NO: 4107 - protein, 9 aa, Homo Sapiens
SNEDFSASP

SEQ ID NO: 4108 - protein, 9 aa, Homo Sapiens
NEDFSASPI

SEQ ID NO: 4109 - protein, 9 aa, Homo Sapiens
IMTPSTLPP

SEQ ID NO: 4110 - protein, 9 aa, Homo Sapiens
RKAGCKLTI

SEQ ID NO: 4111 - protein, 9 aa, Homo Sapiens
ICPQAENRN

SEQ ID NO: 4112 - protein, 9 aa, Homo Sapiens
PQAENRNDR

SEQ ID NO: 4113 - protein, 9 aa, Homo Sapiens
LGYVQAPHK

SEQ ID NO: 4114 - protein, 9 aa, Homo Sapiens
VQAPHKTLP

SEQ ID NO: 4115 - protein, 9 aa, Homo Sapiens
RNGELQDFP

SEQ ID NO: 4116 - protein, 9 aa, Homo Sapiens
TREPRDRSV

SEQ ID NO: 4117 - protein, 9 aa, Homo Sapiens
GNLEVSPPV

SEQ ID NO: 4118 - protein, 9 aa, Homo Sapiens
LPGSSGRRV

SEQ ID NO: 4119 - protein, 9 aa, Homo Sapiens
GSSGRRVTQ

SEQ ID NO: 4120 - protein, 9 aa, Homo Sapiens
AQKVQPPVE

SEQ ID NO: 4121 - protein, 9 aa, Homo Sapiens
VQPPVELFV

SEQ ID NO: 4122 - protein, 9 aa, Homo Sapiens
LSFVPAPDG

SEQ ID NO: 4123 - protein, 9 aa, Homo Sapiens
FQEKQKCGH

SEQ ID NO: 4124 - protein, 9 aa, Homo Sapiens
NKFVQSCID

SEQ ID NO: 4125 - protein, 9 aa, Homo Sapiens
RELGLAECD

SEQ ID NO: 4126 - protein, 9 aa, Homo Sapiens
FKTERKKAT

SEQ ID NO: 4127 - protein, 9 aa, Homo Sapiens
LHGEVHCGT

SEQ ID NO: 4128 - protein, 9 aa, Homo Sapiens
VHCGTNVCR

SEQ ID NO: 4129 - protein, 9 aa, Homo Sapiens
KPFSFKWWN

SEQ ID NO: 4130 - protein, 9 aa, Homo Sapiens
VRVSLEHPT

SEQ ID NO: 4131 - protein, 9 aa, Homo Sapiens
IYGSVPEGT

SEQ ID NO: 4132 - protein, 9 aa, Homo Sapiens
FEVYGTPGV

SEQ ID NO: 4133 - protein, 9 aa, Homo Sapiens
ISPNMERGR

SEQ ID NO: 4134 - protein, 9 aa, Homo Sapiens
RGRERADTR

SEQ ID NO: 4135 - protein, 9 aa, Homo Sapiens
FDATLEIIV

SEQ ID NO: 4136 - protein, 9 aa, Homo Sapiens
SHVQISYHS

SEQ ID NO: 4137 - protein, 9 aa, Homo Sapiens
ISYHSSHEP

SEQ ID NO: 4138 - protein, 9 aa, Homo Sapiens
YHSSHEPLP

SEQ ID NO: 4139 - protein, 9 aa, Homo Sapiens
ISLDCDLNC

SEQ ID NO: 4140 - protein, 9 aa, Homo Sapiens
RQWVWGPSG

SEQ ID NO: 4141 - protein, 9 aa, Homo Sapiens
CDRDDPSCD

SEQ ID NO: 4142 - protein, 9 aa, Homo Sapiens
PSCDVQDNC

SEQ ID NO: 4143 - protein, 9 aa, Homo Sapiens
SCDVQDNCD

SEQ ID NO: 4144 - protein, 9 aa, Homo Sapiens
VHCLQDLED

SEQ ID NO: 4145 - protein, 9 aa, Homo Sapiens
VMVLRTQGP

SEQ ID NO: 4146 - protein, 9 aa, Homo Sapiens
TQGPAALFD

SEQ ID NO: 4147 - protein, 9 aa, Homo Sapiens
PAALFDDHK

SEQ ID NO: 4148 - protein, 9 aa, Homo Sapiens
HKLVLHTSS

SEQ ID NO: 4149 - protein, 9 aa, Homo Sapiens
SSYDAKRAQ

SEQ ID NO: 4150 - protein, 9 aa, Homo Sapiens
FHICGPEDV

SEQ ID NO: 4151 - protein, 9 aa, Homo Sapiens
PEDVCEAYR

SEQ ID NO: 4152 - protein, 9 aa, Homo Sapiens
CEAYRHVLG

SEQ ID NO: 4153 - protein, 9 aa, Homo Sapiens
YRHVLGQDK

SEQ ID NO: 4154 - protein, 9 aa, Homo Sapiens
VSYEVPRLH

SEQ ID NO: 4155 - protein, 9 aa, Homo Sapiens
ISFHVTLLD

SEQ ID NO: 4156 - protein, 9 aa, Homo Sapiens
LDDSNEDFS

SEQ ID NO: 4157 - protein, 9 aa, Homo Sapiens
SPIFTDTVV

SEQ ID NO: 4158 - protein, 9 aa, Homo Sapiens
APWIMTPST

SEQ ID NO: 4159 - protein, 9 aa, Homo Sapiens
TPSTLPPLE

SEQ ID NO: 4160 - protein, 9 aa, Homo Sapiens
VDAVAELAR

SEQ ID NO: 4161 - protein, 9 aa, Homo Sapiens
AELARKAGC

SEQ ID NO: 4162 - protein, 9 aa, Homo Sapiens
AGCKLTICP

SEQ ID NO: 4163 - protein, 9 aa, Homo Sapiens
CKLTICPQA

SEQ ID NO: 4164 - protein, 9 aa, Homo Sapiens
NRNDRWIQD

SEQ ID NO: 4165 - protein, 9 aa, Homo Sapiens
GYVQAPHKT

SEQ ID NO: 4166 - protein, 9 aa, Homo Sapiens
QAPHKTLPV

SEQ ID NO: 4167 - protein, 9 aa, Homo Sapiens
KRILGPDFG

SEQ ID NO: 4168 - protein, 9 aa, Homo Sapiens
LGPDFGYVT

SEQ ID NO: 4169 - protein, 9 aa, Homo Sapiens
GYVTREPRD

SEQ ID NO: 4170 - protein, 9 aa, Homo Sapiens
REPRDRSVS

SEQ ID NO: 4171 - protein, 9 aa, Homo Sapiens
LEVSPPVVA

SEQ ID NO: 4172 - protein, 9 aa, Homo Sapiens
SPPVVANGK

SEQ ID NO: 4173 - protein, 9 aa, Homo Sapiens
IGGNLPGSS

SEQ ID NO: 4174 - protein, 9 aa, Homo Sapiens
GGNLPGSSG

SEQ ID NO: 4175 - protein, 9 aa, Homo Sapiens
HAQKVQPPV

SEQ ID NO: 4176 - protein, 9 aa, Homo Sapiens
PAPDGKGFR

SEQ ID NO: 4177 - protein, 9 aa, Homo Sapiens
FRMLLASPG

SEQ ID NO: 4178 - protein, 9 aa, Homo Sapiens
RMLLASPGA

SEQ ID NO: 4179 - protein, 9 aa, Homo Sapiens
LASPGACFK

SEQ ID NO: 4180 - protein, 9 aa, Homo Sapiens
FKLFQEKQK

SEQ ID NO: 4181 - protein, 9 aa, Homo Sapiens
KQKCGHGRA

SEQ ID NO: 4182 - protein, 9 aa, Homo Sapiens
INQVLSNKD

SEQ ID NO: 4183 - protein, 9 aa, Homo Sapiens
NKDLINYNK

SEQ ID NO: 4184 - protein, 9 aa, Homo Sapiens
YNKFVQSCI

SEQ ID NO: 4185 - protein, 9 aa, Homo Sapiens
PQLFKTERK

SEQ ID NO: 4186 - protein, 9 aa, Homo Sapiens
TAFFPDLVN

SEQ ID NO: 4187 - protein, 9 aa, Homo Sapiens
FPDLVNMLV

SEQ ID NO: 4188 - protein, 9 aa, Homo Sapiens
LGKHLGIPK

SEQ ID NO: 4189 - protein, 9 aa, Homo Sapiens
GPIINGCCC

SEQ ID NO: 4190 - protein, 9 aa, Homo Sapiens
GCCCLEEKV

SEQ ID NO: 4191 - protein, 9 aa, Homo Sapiens
VRSLLEPLG

SEQ ID NO: 4192 - protein, 9 aa, Homo Sapiens
PYHMLHGEV

SEQ ID NO: 4193 - protein, 9 aa, Homo Sapiens
HMLHGEVHC

SEQ ID NO: 4194 - protein, 9 aa, Homo Sapiens
VYGTPGVDI

SEQ ID NO: 4195 - protein, 9 aa, Homo Sapiens
SPNMERGRE

SEQ ID NO: 4196 - protein, 9 aa, Homo Sapiens
NMERGRERA

SEQ ID NO: 4197 - protein, 9 aa, Homo Sapiens
GRERADTRR

SEQ ID NO: 4198 - protein, 9 aa, Homo Sapiens
RERADTRRW

SEQ ID NO: 4199 - protein, 9 aa, Homo Sapiens
TCVDISLDC

SEQ ID NO: 4200 - protein, 9 aa, Homo Sapiens
CDLNCEGRQ

SEQ ID NO: 4201 - protein, 9 aa, Homo Sapiens
GRQDRNFVD

SEQ ID NO: 4202 - protein, 9 aa, Homo Sapiens
VNCDRDDPS

SEQ ID NO: 4203 - protein, 9 aa, Homo Sapiens
CDVQDNCDQ

SEQ ID NO: 4204 - protein, 9 aa, Homo Sapiens
TSSYDAKRA

SEQ ID NO: 4205 - protein, 9 aa, Homo Sapiens
RHVLGQDKV

SEQ ID NO: 4206 - protein, 9 aa, Homo Sapiens
SYEVPRLHG

SEQ ID NO: 4207 - protein, 9 aa, Homo Sapiens
VPRLHGDEE

SEQ ID NO: 4208 - protein, 9 aa, Homo Sapiens
PRLHGDEER

SEQ ID NO: 4209 - protein, 9 aa, Homo Sapiens
ASPIFTDTV

SEQ ID NO: 4210 - protein, 9 aa, Homo Sapiens
FRVAPWIMT

SEQ ID NO: 4211 - protein, 9 aa, Homo Sapiens
PSTLPPLEV

SEQ ID NO: 4212 - protein, 9 aa, Homo Sapiens
VAELARKAG

SEQ ID NO: 4213 - protein, 9 aa, Homo Sapiens
ARKAGCKLT

SEQ ID NO: 4214 - protein, 9 aa, Homo Sapiens
CPQAENRND

SEQ ID NO: 4215 - protein, 9 aa, Homo Sapiens
QAENRNDRW

SEQ ID NO: 4216 - protein, 9 aa, Homo Sapiens
LPVVFDSPR

SEQ ID NO: 4217 - protein, 9 aa, Homo Sapiens
SPRNGELQD

SEQ ID NO: 4218 - protein, 9 aa, Homo Sapiens
RDRSVSGLD

SEQ ID NO: 4219 - protein, 9 aa, Homo Sapiens
VSGLDSFGN

SEQ ID NO: 4220 - protein, 9 aa, Homo Sapiens
LDSFGNLEV

SEQ ID NO: 4221 - protein, 9 aa, Homo Sapiens
PPVVANGKE

SEQ ID NO: 4222 - protein, 9 aa, Homo Sapiens
PGSSGRRVT

SEQ ID NO: 4223 - protein, 9 aa, Homo Sapiens
SGRRVTQVV

SEQ ID NO: 4224 - protein, 9 aa, Homo Sapiens
GRRVTQVVR

SEQ ID NO: 4225 - protein, 9 aa, Homo Sapiens
VDEFLSFVP

SEQ ID NO: 4226 - protein, 9 aa, Homo Sapiens
PGACFKLFQ

SEQ ID NO: 4227 - protein, 9 aa, Homo Sapiens
FQGVVDDEQ

SEQ ID NO: 4228 - protein, 9 aa, Homo Sapiens
QGVVDDEQV

SEQ ID NO: 4229 - protein, 9 aa, Homo Sapiens
VQSCIDWNR

SEQ ID NO: 4230 - protein, 9 aa, Homo Sapiens
QSCIDWNRE

SEQ ID NO: 4231 - protein, 9 aa, Homo Sapiens
IDWNREVLK

SEQ ID NO: 4232 - protein, 9 aa, Homo Sapiens
REVLKRELG

SEQ ID NO: 4233 - protein, 9 aa, Homo Sapiens
IPQLFKTER

SEQ ID NO: 4234 - protein, 9 aa, Homo Sapiens
RKKATAFFP

SEQ ID NO: 4235 - protein, 9 aa, Homo Sapiens
PKPFGPIIN

SEQ ID NO: 4236 - protein, 9 aa, Homo Sapiens
FGPIINGCC

SEQ ID NO: 4237 - protein, 9 aa, Homo Sapiens
INGCCCLEE

SEQ ID NO: 4238 - protein, 9 aa, Homo Sapiens
GEVHCGTNV

SEQ ID NO: 4239 - protein, 9 aa, Homo Sapiens
CGTNVCRKP

SEQ ID NO: 4240 - protein, 9 aa, Homo Sapiens
TNVCRKPFS

SEQ ID NO: 4241 - protein, 9 aa, Homo Sapiens
MTPSTLAPL

SEQ ID NO: 4242 - protein, 9 aa, Homo Sapiens
STLAPLEVY

SEQ ID NO: 4243 - protein, 9 aa, Homo Sapiens
TLAPLEVYV

SEQ ID NO: 4244 - protein, 9 aa, Homo Sapiens
WIMTPSTLA

SEQ ID NO: 4245 - protein, 9 aa, Homo Sapiens
APLEVYVCR

SEQ ID NO: 4246 - protein, 9 aa, Homo Sapiens
LAPLEVYVC

SEQ ID NO: 4247 - protein, 9 aa, Homo Sapiens
IMTPSTLAP

SEQ ID NO: 4248 - protein, 9 aa, Homo Sapiens
TPSTLAPLE

SEQ ID NO: 4249 - protein, 9 aa, Homo Sapiens
PSTLAPLEV

SEQ ID NO: 4250 - protein, 9 aa, Homo Sapiens
EFLSFVPVP

SEQ ID NO: 4251 - protein, 9 aa, Homo Sapiens
DEFLSFVPV

SEQ ID NO: 4252 - protein, 9 aa, Homo Sapiens
VPVPDGKGF

SEQ ID NO: 4253 - protein, 9 aa, Homo Sapiens
VPDGKGFRM

SEQ ID NO: 4254 - protein, 9 aa, Homo Sapiens
FVPVPDGKG

SEQ ID NO: 4255 - protein, 9 aa, Homo Sapiens
PVPDGKGFR

SEQ ID NO: 4256 - protein, 9 aa, Homo Sapiens
FLSFVPVPD

SEQ ID NO: 4257 - protein, 9 aa, Homo Sapiens
SFVPVPDGK

SEQ ID NO: 4258 - protein, 9 aa, Homo Sapiens
LSFVPVPDG

SEQ ID NO: 4259 - protein, 9 aa, Homo Sapiens
GPSGYGGIL

SEQ ID NO: 4260 - protein, 9 aa, Homo Sapiens
FPDAGFTGL

SEQ ID NO: 4261 - protein, 9 aa, Homo Sapiens
APDGKGFRM

SEQ ID NO: 4262 - protein, 9 aa, Homo Sapiens
APHKTLPVV

SEQ ID NO: 4263 - protein, 9 aa, Homo Sapiens
APWIMTPST

SEQ ID NO: 4264 - protein, 9 aa, Homo Sapiens
IPKPFGPII

SEQ ID NO: 4265 - protein, 9 aa, Homo Sapiens
EPLPLAYAV

SEQ ID NO: 4266 - protein, 9 aa, Homo Sapiens
VPAPDGKGF

SEQ ID NO: 4267 - protein, 9 aa, Homo Sapiens
SPGACFKLF

SEQ ID NO: 4268 - protein, 9 aa, Homo Sapiens
EPLGLHCTF

SEQ ID NO: 4269 - protein, 9 aa, Homo Sapiens
HPTSAVCVA

SEQ ID NO: 4270 - protein, 9 aa, Homo Sapiens
SPIFTDTVV

SEQ ID NO: 4271 - protein, 9 aa, Homo Sapiens
LPGSSGRRV

SEQ ID NO: 4272 - protein, 9 aa, Homo Sapiens
FPDLVNMLV

SEQ ID NO: 4273 - protein, 9 aa, Homo Sapiens
KPFGPIING

SEQ ID NO: 4274 - protein, 9 aa, Homo Sapiens
LQRIVRVSL

SEQ ID NO: 4275 - protein, 9 aa, Homo Sapiens
HSSHEPLPL

SEQ ID NO: 4276 - protein, 9 aa, Homo Sapiens
KVSYEVPRL

SEQ ID NO: 4277 - protein, 9 aa, Homo Sapiens
EPRDRSVSG

SEQ ID NO: 4278 - protein, 9 aa, Homo Sapiens
QKVQPPVEL

SEQ ID NO: 4279 - protein, 9 aa, Homo Sapiens
PLAYAVLYL

SEQ ID NO: 4280 - protein, 9 aa, Homo Sapiens
LFDDHKLVL

SEQ ID NO: 4281 - protein, 9 aa, Homo Sapiens
EERFFVEGL

SEQ ID NO: 4282 - protein, 9 aa, Homo Sapiens
LISFHVTLL

SEQ ID NO: 4283 - protein, 9 aa, Homo Sapiens
LARKAGCKL

SEQ ID NO: 4284 - protein, 9 aa, Homo Sapiens
YVQAPHKTL

SEQ ID NO: 4285 - protein, 9 aa, Homo Sapiens
SPRNGELQD

SEQ ID NO: 4286 - protein, 9 aa, Homo Sapiens
YPLGRILIG

SEQ ID NO: 4287 - protein, 9 aa, Homo Sapiens
AVGHVDEFL

SEQ ID NO: 4288 - protein, 9 aa, Homo Sapiens
ASPGACFKL

SEQ ID NO: 4289 - protein, 9 aa, Homo Sapiens
QKCGHGRAL

SEQ ID NO: 4290 - protein, 9 aa, Homo Sapiens
KCGHGRALL

SEQ ID NO: 4291 - protein, 9 aa, Homo Sapiens
EVLKRELGL

SEQ ID NO: 4292 - protein, 9 aa, Homo Sapiens
KATAFFPDL

SEQ ID NO: 4293 - protein, 9 aa, Homo Sapiens
KVRSLLEPL

SEQ ID NO: 4294 - protein, 9 aa, Homo Sapiens
VPEGTEMFE

SEQ ID NO: 4295 - protein, 9 aa, Homo Sapiens
VYGTPGVDI

SEQ ID NO: 4296 - protein, 9 aa, Homo Sapiens
VMNSPSNDL

SEQ ID NO: 4297 - protein, 9 aa, Homo Sapiens
LPLAYAVLY

SEQ ID NO: 4298 - protein, 9 aa, Homo Sapiens
DPSCDVQDN

SEQ ID NO: 4299 - protein, 9 aa, Homo Sapiens
LEDMSVMVL

SEQ ID NO: 4300 - protein, 9 aa, Homo Sapiens
RTQGPAALF

SEQ ID NO: 4301 - protein, 9 aa, Homo Sapiens
GPAALFDDH

SEQ ID NO: 4302 - protein, 9 aa, Homo Sapiens
VCEAYRHVL

SEQ ID NO: 4303 - protein, 9 aa, Homo Sapiens
VPRLHGDEE

SEQ ID NO: 4304 - protein, 9 aa, Homo Sapiens
TPSTLPPLE

SEQ ID NO: 4305 - protein, 9 aa, Homo Sapiens
FDSPRNGEL

SEQ ID NO: 4306 - protein, 9 aa, Homo Sapiens
FPYKRILGP

SEQ ID NO: 4307 - protein, 9 aa, Homo Sapiens
GPDFGYVTR

SEQ ID NO: 4308 - protein, 9 aa, Homo Sapiens
VANGKEYPL

SEQ ID NO: 4309 - protein, 9 aa, Homo Sapiens
KEYPLGRIL

SEQ ID NO: 4310 - protein, 9 aa, Homo Sapiens
PPVELFVDW

SEQ ID NO: 4311 - protein, 9 aa, Homo Sapiens
PDGKGFRML

SEQ ID NO: 4312 - protein, 9 aa, Homo Sapiens
DGKGFRMLL

SEQ ID NO: 4313 - protein, 9 aa, Homo Sapiens
CIDWNREVL

SEQ ID NO: 4314 - protein, 9 aa, Homo Sapiens
PDLVNMLVL

SEQ ID NO: 4315 - protein, 9 aa, Homo Sapiens
RSLLEPLGL

SEQ ID NO: 4316 - protein, 9 aa, Homo Sapiens
DDFTPYHML

SEQ ID NO: 4317 - protein, 9 aa, Homo Sapiens
VCVAGVETL

SEQ ID NO: 4318 - protein, 9 aa, Homo Sapiens
RRWRFDATL

SEQ ID NO: 4319 - protein, 9 aa, Homo Sapiens
SPSNDLNDS

SEQ ID NO: 4320 - protein, 9 aa, Homo Sapiens
PLPLAYAVL

SEQ ID NO: 4321 - protein, 9 aa, Homo Sapiens
PSGYGGILL

SEQ ID NO: 4322 - protein, 9 aa, Homo Sapiens
NCDQHVHCL

SEQ ID NO: 4323 - protein, 9 aa, Homo Sapiens
LRTQGPAAL

SEQ ID NO: 4324 - protein, 9 aa, Homo Sapiens
AALFDDHKL

SEQ ID NO: 4325 - protein, 9 aa, Homo Sapiens
AKRAQVFHI

SEQ ID NO: 4326 - protein, 9 aa, Homo Sapiens
GLSFPDAGF

SEQ ID NO: 4327 - protein, 9 aa, Homo Sapiens
GLISFHVTL

SEQ ID NO: 4328 - protein, 9 aa, Homo Sapiens
MTPSTLPPL

SEQ ID NO: 4329 - protein, 9 aa, Homo Sapiens
LPPLEVYVC

SEQ ID NO: 4330 - protein, 9 aa, Homo Sapiens
PPLEVYVCR

SEQ ID NO: 4331 - protein, 9 aa, Homo Sapiens
CFVDAVAEL

SEQ ID NO: 4332 - protein, 9 aa, Homo Sapiens
RKAGCKLTI

SEQ ID NO: 4333 - protein, 9 aa, Homo Sapiens
PRDRSVSGL

SEQ ID NO: 4334 - protein, 9 aa, Homo Sapiens
LEVSPPVVA

SEQ ID NO: 4335 - protein, 9 aa, Homo Sapiens
VTQVVRDFL

SEQ ID NO: 4336 - protein, 9 aa, Homo Sapiens
KVQPPVELF

SEQ ID NO: 4337 - protein, 9 aa, Homo Sapiens
LLASPGACF

SEQ ID NO: 4338 - protein, 9 aa, Homo Sapiens
KTISINQVL

SEQ ID NO: 4339 - protein, 9 aa, Homo Sapiens
IPQLFKTER

SEQ ID NO: 4340 - protein, 9 aa, Homo Sapiens
GIPKPFGPI

SEQ ID NO: 4341 - protein, 9 aa, Homo Sapiens
LEEKVRSLL

SEQ ID NO: 4342 - protein, 9 aa, Homo Sapiens
SLEHPTSAV

SEQ ID NO: 4343 - protein, 9 aa, Homo Sapiens
AVCVAGVET

SEQ ID NO: 4344 - protein, 9 aa, Homo Sapiens
TPGVDIYIS

SEQ ID NO: 4345 - protein, 9 aa, Homo Sapiens
SPNMERGRE

SEQ ID NO: 4346 - protein, 9 aa, Homo Sapiens
ATLEIIVVM

SEQ ID NO: 4347 - protein, 9 aa, Homo Sapiens
SYHSSHEPL

SEQ ID NO: 4348 - protein, 9 aa, Homo Sapiens
EGRQDRNFV

SEQ ID NO: 4349 - protein, 9 aa, Homo Sapiens
DMSVMVLRT

SEQ ID NO: 4350 - protein, 9 aa, Homo Sapiens
VLRTQGPAA

SEQ ID NO: 4351 - protein, 9 aa, Homo Sapiens
GPEDVCEAY

SEQ ID NO: 4352 - protein, 9 aa, Homo Sapiens
SASPIFTDT

SEQ ID NO: 4353 - protein, 9 aa, Homo Sapiens
PSTLPPLEV

SEQ ID NO: 4354 - protein, 9 aa, Homo Sapiens
RVRNNTCFV

SEQ ID NO: 4355 - protein, 9 aa, Homo Sapiens
CPQAENRND

SEQ ID NO: 4356 - protein, 9 aa, Homo Sapiens
RWIQDEMEL

SEQ ID NO: 4357 - protein, 9 aa, Homo Sapiens
LPVVFDSPR

SEQ ID NO: 4358 - protein, 9 aa, Homo Sapiens
QDFPYKRIL

SEQ ID NO: 4359 - protein, 9 aa, Homo Sapiens
SGLDSFGNL

SEQ ID NO: 4360 - protein, 9 aa, Homo Sapiens
EVSPPVVAN

SEQ ID NO: 4361 - protein, 9 aa, Homo Sapiens
GRILIGGNL

SEQ ID NO: 4362 - protein, 9 aa, Homo Sapiens
QPPVELFVD

SEQ ID NO: 4363 - protein, 9 aa, Homo Sapiens
PVELFVDWL

SEQ ID NO: 4364 - protein, 9 aa, Homo Sapiens
CDIIDIPQL

SEQ ID NO: 4365 - protein, 9 aa, Homo Sapiens
TERKKATAF

SEQ ID NO: 4366 - protein, 9 aa, Homo Sapiens
ERKKATAFF

SEQ ID NO: 4367 - protein, 9 aa, Homo Sapiens
AFFPDLVNM

SEQ ID NO: 4368 - protein, 9 aa, Homo Sapiens
FFPDLVNML

SEQ ID NO: 4369 - protein, 9 aa, Homo Sapiens
NMLVLGKHL

SEQ ID NO: 4370 - protein, 9 aa, Homo Sapiens
GPIINGCCC

SEQ ID NO: 4371 - protein, 9 aa, Homo Sapiens
CLEEKVRSL

SEQ ID NO: 4372 - protein, 9 aa, Homo Sapiens
KPFSFKWWN

SEQ ID NO: 4373 - protein, 9 aa, Homo Sapiens
CVAGVETLV

SEQ ID NO: 4374 - protein, 9 aa, Homo Sapiens
AGVETLVDI

SEQ ID NO: 4375 - protein, 9 aa, Homo Sapiens
ERGRERADT

SEQ ID NO: 4376 - protein, 9 aa, Homo Sapiens
TRRWRFDAT

SEQ ID NO: 4377 - protein, 9 aa, Homo Sapiens
SSHEPLPLA

SEQ ID NO: 4378 - protein, 9 aa, Homo Sapiens
HEPLPLAYA

SEQ ID NO: 4379 - protein, 9 aa, Homo Sapiens
YLTCVDISL

SEQ ID NO: 4380 - protein, 9 aa, Homo Sapiens
VDISLDCDL

SEQ ID NO: 4381 - protein, 9 aa, Homo Sapiens
SGYGGILLV

SEQ ID NO: 4382 - protein, 9 aa, Homo Sapiens
DRDDPSCDV

SEQ ID NO: 4383 - protein, 9 aa, Homo Sapiens
QHVHCLQDL

SEQ ID NO: 4384 - protein, 9 aa, Homo Sapiens
DDHKLVLHT

SEQ ID NO: 4385 - protein, 9 aa, Homo Sapiens
SYDAKRAQV

SEQ ID NO: 4386 - protein, 9 aa, Homo Sapiens
RFFVEGLSF

SEQ ID NO: 4387 - protein, 9 aa, Homo Sapiens
PDAGFTGLI

SEQ ID NO: 4388 - protein, 9 aa, Homo Sapiens
DFSASPIFT

SEQ ID NO: 4389 - protein, 9 aa, Homo Sapiens
PIFTDTVVF

SEQ ID NO: 4390 - protein, 9 aa, Homo Sapiens
FRVAPWIMT

SEQ ID NO: 4391 - protein, 9 aa, Homo Sapiens
PWIMTPSTL

SEQ ID NO: 4392 - protein, 9 aa, Homo Sapiens
RNNTCFVDA

SEQ ID NO: 4393 - protein, 9 aa, Homo Sapiens
QAPHKTLPV

SEQ ID NO: 4394 - protein, 9 aa, Homo Sapiens
LQDFPYKRI

SEQ ID NO: 4395 - protein, 9 aa, Homo Sapiens
YKRILGPDF

SEQ ID NO: 4396 - protein, 9 aa, Homo Sapiens
ILGPDFGYV

SEQ ID NO: 4397 - protein, 9 aa, Homo Sapiens
LDSFGNLEV

SEQ ID NO: 4398 - protein, 9 aa, Homo Sapiens
SPPVVANGK

SEQ ID NO: 4399 - protein, 9 aa, Homo Sapiens
PPVVANGKE

SEQ ID NO: 4400 - protein, 9 aa, Homo Sapiens
PGSSGRRVT

SEQ ID NO: 4401 - protein, 9 aa, Homo Sapiens
SGRRVTQVV

SEQ ID NO: 4402 - protein, 9 aa, Homo Sapiens
VQPPVELFV

SEQ ID NO: 4403 - protein, 9 aa, Homo Sapiens
ELFVDWLAV

SEQ ID NO: 4404 - protein, 9 aa, Homo Sapiens
DEFLSFVPA

SEQ ID NO: 4405 - protein, 9 aa, Homo Sapiens
CGHGRALLF

SEQ ID NO: 4406 - protein, 9 aa, Homo Sapiens
NQVLSNKDL

SEQ ID NO: 4407 - protein, 9 aa, Homo Sapiens
NREVLKREL

SEQ ID NO: 4408 - protein, 9 aa, Homo Sapiens
LVLGKHLGI

SEQ ID NO: 4409 - protein, 9 aa, Homo Sapiens
KHLGIPKPF

SEQ ID NO: 4410 - protein, 9 aa, Homo Sapiens
PIINGCCCL

SEQ ID NO: 4411 - protein, 9 aa, Homo Sapiens
TPYHMLHGE

SEQ ID NO: 4412 - protein, 9 aa, Homo Sapiens
EHPTSAVCV

SEQ ID NO: 4413 - protein, 9 aa, Homo Sapiens
TSAVCVAGV

SEQ ID NO: 4414 - protein, 9 aa, Homo Sapiens
GSVPEGTEM

SEQ ID NO: 4415 - protein, 9 aa, Homo Sapiens
RADTRRWRF

SEQ ID NO: 4416 - protein, 9 aa, Homo Sapiens
DTRRWRFDA

SEQ ID NO: 4417 - protein, 9 aa, Homo Sapiens
WRFDATLEI

SEQ ID NO: 4418 - protein, 9 aa, Homo Sapiens
RFDATLEII

SEQ ID NO: 4419 - protein, 9 aa, Homo Sapiens
YDAKRAQVF

SEQ ID NO: 4420 - protein, 9 aa, Homo Sapiens
RLHGDEERF

SEQ ID NO: 4421 - protein, 9 aa, Homo Sapiens
HGDEERFFV

SEQ ID NO: 4422 - protein, 9 aa, Homo Sapiens
VEGLSFPDA

SEQ ID NO: 4423 - protein, 9 aa, Homo Sapiens
ASPIFTDTV

SEQ ID NO: 4424 - protein, 9 aa, Homo Sapiens
TLPPLEVYV

SEQ ID NO: 4425 - protein, 9 aa, Homo Sapiens
AVAELARKA

SEQ ID NO: 4426 - protein, 9 aa, Homo Sapiens
ARKAGCKLT

SEQ ID NO: 4427 - protein, 9 aa, Homo Sapiens
EMELGYVQA

SEQ ID NO: 4428 - protein, 9 aa, Homo Sapiens
PHKTLPVVF

SEQ ID NO: 4429 - protein, 9 aa, Homo Sapiens
GKEYPLGRI

SEQ ID NO: 4430 - protein, 9 aa, Homo Sapiens
SSGRRVTQV

SEQ ID NO: 4431 - protein, 9 aa, Homo Sapiens
QVVRDFLHA

SEQ ID NO: 4432 - protein, 9 aa, Homo Sapiens
HAQKVQPPV

SEQ ID NO: 4433 - protein, 9 aa, Homo Sapiens
LAVGHVDEF

SEQ ID NO: 4434 - protein, 9 aa, Homo Sapiens
GHVDEFLSF

SEQ ID NO: 4435 - protein, 9 aa, Homo Sapiens
GKGFRMLLA

SEQ ID NO: 4436 - protein, 9 aa, Homo Sapiens
VVDDEQVKT

SEQ ID NO: 4437 - protein, 9 aa, Homo Sapiens
ATAFFPDLV

SEQ ID NO: 4438 - protein, 9 aa, Homo Sapiens
PLGLHCTFI

SEQ ID NO: 4439 - protein, 9 aa, Homo Sapiens
MSLQRIVRV

SEQ ID NO: 4440 - protein, 9 aa, Homo Sapiens
IYGSVPEGT

SEQ ID NO: 4441 - protein, 9 aa, Homo Sapiens
TEMFEVYGT

SEQ ID NO: 4442 - protein, 9 aa, Homo Sapiens
FEVYGTPGV

SEQ ID NO: 4443 - protein, 9 aa, Homo Sapiens
GTPGVDIYI

SEQ ID NO: 4444 - protein, 9 aa, Homo Sapiens
DLNDSHVQI

SEQ ID NO: 4445 - protein, 9 aa, Homo Sapiens
VLYLTCVDI

SEQ ID NO: 4446 - protein, 9 aa, Homo Sapiens
DLEDMSVMV

SEQ ID NO: 4447 - protein, 9 aa, Homo Sapiens
ALFDDHKLV

SEQ ID NO: 4448 - protein, 9 aa, Homo Sapiens
TSSYDAKRA

SEQ ID NO: 4449 - protein, 9 aa, Homo Sapiens
GQDKVSYEV

SEQ ID NO: 4450 - protein, 9 aa, Homo Sapiens
LHGDEERFF

SEQ ID NO: 4451 - protein, 9 aa, Homo Sapiens
LSFPDAGFT

SEQ ID NO: 4452 - protein, 9 aa, Homo Sapiens
AGFTGLISF

SEQ ID NO: 4453 - protein, 9 aa, Homo Sapiens
TGLISFHVT

SEQ ID NO: 4454 - protein, 9 aa, Homo Sapiens
DDSNEDFSA

SEQ ID NO: 4455 - protein, 9 aa, Homo Sapiens
NEDFSASPI

SEQ ID NO: 4456 - protein, 9 aa, Homo Sapiens
EDFSASPIF

SEQ ID NO: 4457 - protein, 9 aa, Homo Sapiens
FTDTVVFRV

SEQ ID NO: 4458 - protein, 9 aa, Homo Sapiens
TDTVVFRVA

SEQ ID NO: 4459 - protein, 9 aa, Homo Sapiens
VFRVAPWIM

SEQ ID NO: 4460 - protein, 9 aa, Homo Sapiens
NNTCFVDAV

SEQ ID NO: 4461 - protein, 9 aa, Homo Sapiens
NTCFVDAVA

SEQ ID NO: 4462 - protein, 9 aa, Homo Sapiens
FVDAVAELA

SEQ ID NO: 4463 - protein, 9 aa, Homo Sapiens
AENRNDRWI

SEQ ID NO: 4464 - protein, 9 aa, Homo Sapiens
NDRWIQDEM

SEQ ID NO: 4465 - protein, 9 aa, Homo Sapiens
PRNGELQDF

SEQ ID NO: 4466 - protein, 9 aa, Homo Sapiens
LGPDFGYVT

SEQ ID NO: 4467 - protein, 9 aa, Homo Sapiens
GNLEVSPPV

SEQ ID NO: 4468 - protein, 9 aa, Homo Sapiens
NLEVSPPVV

SEQ ID NO: 4469 - protein, 9 aa, Homo Sapiens
EYPLGRILI

SEQ ID NO: 4470 - protein, 9 aa, Homo Sapiens
RVTQVVRDF

SEQ ID NO: 4471 - protein, 9 aa, Homo Sapiens
HVDEFLSFV

SEQ ID NO: 4472 - protein, 9 aa, Homo Sapiens
RMLLASPGA

SEQ ID NO: 4473 - protein, 9 aa, Homo Sapiens
GRALLFQGV

SEQ ID NO: 4474 - protein, 9 aa, Homo Sapiens
RALLFQGVV

SEQ ID NO: 4475 - protein, 9 aa, Homo Sapiens
VDDEQVKTI

SEQ ID NO: 4476 - protein, 9 aa, Homo Sapiens
ELGLAECDI

SEQ ID NO: 4477 - protein, 9 aa, Homo Sapiens
IIDIPQLFK

SEQ ID NO: 4478 - protein, 9 aa, Homo Sapiens
IDIPQLFKT

SEQ ID NO: 4479 - protein, 9 aa, Homo Sapiens
KTERKKATA

SEQ ID NO: 4480 - protein, 9 aa, Homo Sapiens
IDDFTPYHM

SEQ ID NO: 4481 - protein, 9 aa, Homo Sapiens
GEVHCGTNV

SEQ ID NO: 4482 - protein, 9 aa, Homo Sapiens
GTNVCRKPF

SEQ ID NO: 4483 - protein, 9 aa, Homo Sapiens
VCRKPFSFK

SEQ ID NO: 4484 - protein, 9 aa, Homo Sapiens
PFSFKWWNM

SEQ ID NO: 4485 - protein, 9 aa, Homo Sapiens
VRVSLEHPT

SEQ ID NO: 4486 - protein, 9 aa, Homo Sapiens
VSLEHPTSA

SEQ ID NO: 4487 - protein, 9 aa, Homo Sapiens
SVPEGTEMF

SEQ ID NO: 4488 - protein, 9 aa, Homo Sapiens
PEGTEMFEV

SEQ ID NO: 4489 - protein, 9 aa, Homo Sapiens
VDIYISPNM

SEQ ID NO: 4490 - protein, 9 aa, Homo Sapiens
NMERGRERA

SEQ ID NO: 4491 - protein, 9 aa, Homo Sapiens
FDATLEIIV

SEQ ID NO: 4492 - protein, 9 aa, Homo Sapiens
DATLEIIVV

SEQ ID NO: 4493 - protein, 9 aa, Homo Sapiens
SNDLNDSHV

SEQ ID NO: 4494 - protein, 9 aa, Homo Sapiens
LAYAVLYLT

SEQ ID NO: 4495 - protein, 9 aa, Homo Sapiens
YAVLYLTCV

SEQ ID NO: 4496 - protein, 9 aa, Homo Sapiens
CEGRQDRNF

SEQ ID NO: 4497 - protein, 9 aa, Homo Sapiens
NFVDKRQWV

SEQ ID NO: 4498 - protein, 9 aa, Homo Sapiens
VQDNCDQHV

SEQ ID NO: 4499 - protein, 9 aa, Homo Sapiens
LQDLEDMSV

SEQ ID NO: 4500 - protein, 9 aa, Homo Sapiens
QDLEDMSVM

SEQ ID NO: 4501 - protein, 9 aa, Homo Sapiens
MVLRTQGPA

SEQ ID NO: 4502 - protein, 9 aa, Homo Sapiens
CGPEDVCEA

SEQ ID NO: 4503 - protein, 9 aa, Homo Sapiens
RHVLGQDKV

SEQ ID NO: 4504 - protein, 9 aa, Homo Sapiens
FTGLISFHV

SEQ ID NO: 4505 - protein, 9 aa, Homo Sapiens
LLDDSNEDF

SEQ ID NO: 4506 - protein, 9 aa, Homo Sapiens
VVFRVAPWI

SEQ ID NO: 4507 - protein, 9 aa, Homo Sapiens
PLEVYVCRV

SEQ ID NO: 4508 - protein, 9 aa, Homo Sapiens
YVCRVRNNT

SEQ ID NO: 4509 - protein, 9 aa, Homo Sapiens
CRVRNNTCF

SEQ ID NO: 4510 - protein, 9 aa, Homo Sapiens
CKLTICPQA

SEQ ID NO: 4511 - protein, 9 aa, Homo Sapiens
HKTLPVVFD

SEQ ID NO: 4512 - protein, 9 aa, Homo Sapiens
TREPRDRSV

SEQ ID NO: 4513 - protein, 9 aa, Homo Sapiens
RSVSGLDSF

SEQ ID NO: 4514 - protein, 9 aa, Homo Sapiens
GSSGRRVTQ

SEQ ID NO: 4515 - protein, 9 aa, Homo Sapiens
RDFLHAQKV

SEQ ID NO: 4516 - protein, 9 aa, Homo Sapiens
VDWLAVGHV

SEQ ID NO: 4517 - protein, 9 aa, Homo Sapiens
KQKCGHGRA

SEQ ID NO: 4518 - protein, 9 aa, Homo Sapiens
DEQVKTISI

SEQ ID NO: 4519 - protein, 9 aa, Homo Sapiens
KDLINYNKF

SEQ ID NO: 4520 - protein, 9 aa, Homo Sapiens
DLINYNKFV

SEQ ID NO: 4521 - protein, 9 aa, Homo Sapiens
LGLAECDII

SEQ ID NO: 4522 - protein, 9 aa, Homo Sapiens
LFKTERKKA

SEQ ID NO: 4523 - protein, 9 aa, Homo Sapiens
FKTERKKAT

SEQ ID NO: 4524 - protein, 9 aa, Homo Sapiens
HCTFIDDFT

SEQ ID NO: 4525 - protein, 9 aa, Homo Sapiens
LHGEVHCGT

SEQ ID NO: 4526 - protein, 9 aa, Homo Sapiens
FSFKWWNMV

SEQ ID NO: 4527 - protein, 9 aa, Homo Sapiens
PTSAVCVAG

SEQ ID NO: 4528 - protein, 9 aa, Homo Sapiens
TLVDIYGSV

SEQ ID NO: 4529 - protein, 9 aa, Homo Sapiens
WGPSGYGGI

SEQ ID NO: 4530 - protein, 9 aa, Homo Sapiens
GYGGILLVN

SEQ ID NO: 4531 - protein, 9 aa, Homo Sapiens
HCLQDLEDM

SEQ ID NO: 4532 - protein, 9 aa, Homo Sapiens
VLHTSSYDA

SEQ ID NO: 4533 - protein, 9 aa, Homo Sapiens
FHICGPEDV

SEQ ID NO: 4534 - protein, 9 aa, Homo Sapiens
HICGPEDVC

SEQ ID NO: 4535 - protein, 9 aa, Homo Sapiens
DVCEAYRHV

SEQ ID NO: 4536 - protein, 9 aa, Homo Sapiens
SYEVPRLHG

SEQ ID NO: 4537 - protein, 9 aa, Homo Sapiens
IMTPSTLPP

SEQ ID NO: 4538 - protein, 9 aa, Homo Sapiens
QDEMELGYV

SEQ ID NO: 4539 - protein, 9 aa, Homo Sapiens
GYVQAPHKT

SEQ ID NO: 4540 - protein, 9 aa, Homo Sapiens
RILGPDFGY

SEQ ID NO: 4541 - protein, 9 aa, Homo Sapiens
VTREPRDRS

SEQ ID NO: 4542 - protein, 9 aa, Homo Sapiens
ILIGGNLPG

SEQ ID NO: 4543 - protein, 9 aa, Homo Sapiens
VELFVDWLA

SEQ ID NO: 4544 - protein, 9 aa, Homo Sapiens
ALLFQGVVD

SEQ ID NO: 4545 - protein, 9 aa, Homo Sapiens
QGVVDDEQV

SEQ ID NO: 4546 - protein, 9 aa, Homo Sapiens
VKTISINQV

SEQ ID NO: 4547 - protein, 9 aa, Homo Sapiens
QVLSNKDLI

SEQ ID NO: 4548 - protein, 9 aa, Homo Sapiens
YNKFVQSCI

SEQ ID NO: 4549 - protein, 9 aa, Homo Sapiens
SCIDWNREV

SEQ ID NO: 4550 - protein, 9 aa, Homo Sapiens
VLKRELGLA

SEQ ID NO: 4551 - protein, 9 aa, Homo Sapiens
LKRELGLAE

SEQ ID NO: 4552 - protein, 9 aa, Homo Sapiens
LAECDIIDI

SEQ ID NO: 4553 - protein, 9 aa, Homo Sapiens
DIIDIPQLF

SEQ ID NO: 4554 - protein, 9 aa, Homo Sapiens
TAFFPDLVN

SEQ ID NO: 4555 - protein, 9 aa, Homo Sapiens
HLGIPKPFG

SEQ ID NO: 4556 - protein, 9 aa, Homo Sapiens
GCCCLEEKV

SEQ ID NO: 4557 - protein, 9 aa, Homo Sapiens
LEPLGLHCT

SEQ ID NO: 4558 - protein, 9 aa, Homo Sapiens
LHCTFIDDF

SEQ ID NO: 4559 - protein, 9 aa, Homo Sapiens
PYHMLHGEV

SEQ ID NO: 4560 - protein, 9 aa, Homo Sapiens
NVCRKPFSF

SEQ ID NO: 4561 - protein, 9 aa, Homo Sapiens
VAGVETLVD

SEQ ID NO: 4562 - protein, 9 aa, Homo Sapiens
YGSVPEGTE

SEQ ID NO: 4563 - protein, 9 aa, Homo Sapiens
MERGRERAD

SEQ ID NO: 4564 - protein, 9 aa, Homo Sapiens
RERADTRRW

SEQ ID NO: 4565 - protein, 9 aa, Homo Sapiens
AYAVLYLTC

SEQ ID NO: 4566 - protein, 9 aa, Homo Sapiens
RQDRNFVDK

SEQ ID NO: 4567 - protein, 9 aa, Homo Sapiens
WVWGPSGYG

SEQ ID NO: 4568 - protein, 9 aa, Homo Sapiens
TQGPAALFD

SEQ ID NO: 4569 - protein, 9 aa, Homo Sapiens
ICGPEDVCE

SEQ ID NO: 4570 - protein, 9 aa, Homo Sapiens
IFTDTVVFR

SEQ ID NO: 4571 - protein, 9 aa, Homo Sapiens
WIMTPSTLP

SEQ ID NO: 4572 - protein, 9 aa, Homo Sapiens
STLPPLEVY

SEQ ID NO: 4573 - protein, 9 aa, Homo Sapiens
VFDSPRNGE

SEQ ID NO: 4574 - protein, 9 aa, Homo Sapiens
DRSVSGLDS

SEQ ID NO: 4575 - protein, 9 aa, Homo Sapiens
SVSGLDSFG

SEQ ID NO: 4576 - protein, 9 aa, Homo Sapiens
ANGKEYPLG

SEQ ID NO: 4577 - protein, 9 aa, Homo Sapiens
GRRVTQVVR

SEQ ID NO: 4578 - protein, 9 aa, Homo Sapiens
RVSLEHPTS

SEQ ID NO: 4579 - protein, 9 aa, Homo Sapiens
DIYGSVPEG

SEQ ID NO: 4580 - protein, 9 aa, Homo Sapiens
EVYGTPGVD

SEQ ID NO: 4581 - protein, 9 aa, Homo Sapiens
IYISPNMER

SEQ ID NO: 4582 - protein, 9 aa, Homo Sapiens
RWRFDATLE

SEQ ID NO: 4583 - protein, 9 aa, Homo Sapiens
SHEPLPLAY

SEQ ID NO: 4584 - protein, 9 aa, Homo Sapiens
AVLYLTCVD

SEQ ID NO: 4585 - protein, 9 aa, Homo Sapiens
RDDPSCDVQ

SEQ ID NO: 4586 - protein, 9 aa, Homo Sapiens
EDMSVMVLR

SEQ ID NO: 4587 - protein, 9 aa, Homo Sapiens
EAYRHVLGQ

SEQ ID NO: 4588 - protein, 9 aa, Homo Sapiens
AYRHVLGQD

SEQ ID NO: 4589 - protein, 9 aa, Homo Sapiens
DAGFTGLIS

SEQ ID NO: 4590 - protein, 9 aa, Homo Sapiens
ISFHVTLLD

SEQ ID NO: 4591 - protein, 9 aa, Homo Sapiens
FSASPIFTD

SEQ ID NO: 4592 - protein, 9 aa, Homo Sapiens
DTVVFRVAP

SEQ ID NO: 4593 - protein, 9 aa, Homo Sapiens
EVYVCRVRN

SEQ ID NO: 4594 - protein, 9 aa, Homo Sapiens
VDAVAELAR

SEQ ID NO: 4595 - protein, 9 aa, Homo Sapiens
AELARKAGC

SEQ ID NO: 4596 - protein, 9 aa, Homo Sapiens
AGCKLTICP

SEQ ID NO: 4597 - protein, 9 aa, Homo Sapiens
LTICPQAEN

SEQ ID NO: 4598 - protein, 9 aa, Homo Sapiens
ENRNDRWIQ

SEQ ID NO: 4599 - protein, 9 aa, Homo Sapiens
IQDEMELGY

SEQ ID NO: 4600 - protein, 9 aa, Homo Sapiens
MELGYVQAP

SEQ ID NO: 4601 - protein, 9 aa, Homo Sapiens
ELGYVQAPH

SEQ ID NO: 4602 - protein, 9 aa, Homo Sapiens
PDFGYVTRE

SEQ ID NO: 4603 - protein, 9 aa, Homo Sapiens
LIGGNLPGS

SEQ ID NO: 4604 - protein, 9 aa, Homo Sapiens
GGNLPGSSG

SEQ ID NO: 4605 - protein, 9 aa, Homo Sapiens
RRVTQVVRD

SEQ ID NO: 4606 - protein, 9 aa, Homo Sapiens
AQKVQPPVE

SEQ ID NO: 4607 - protein, 9 aa, Homo Sapiens
EFLSFVPAP

SEQ ID NO: 4608 - protein, 9 aa, Homo Sapiens
FLSFVPAPD

SEQ ID NO: 4609 - protein, 9 aa, Homo Sapiens
LSFVPAPDG

SEQ ID NO: 4610 - protein, 9 aa, Homo Sapiens
FVPAPDGKG

SEQ ID NO: 4611 - protein, 9 aa, Homo Sapiens
KGFRMLLAS

SEQ ID NO: 4612 - protein, 9 aa, Homo Sapiens
LASPGACFK

SEQ ID NO: 4613 - protein, 9 aa, Homo Sapiens
PGACFKLFQ

SEQ ID NO: 4614 - protein, 9 aa, Homo Sapiens
ACFKLFQEK

SEQ ID NO: 4615 - protein, 9 aa, Homo Sapiens
GHGRALLFQ

SEQ ID NO: 4616 - protein, 9 aa, Homo Sapiens
TISINQVLS

SEQ ID NO: 4617 - protein, 9 aa, Homo Sapiens
ISINQVLSN

SEQ ID NO: 4618 - protein, 9 aa, Homo Sapiens
VLSNKDLIN

SEQ ID NO: 4619 - protein, 9 aa, Homo Sapiens
INYNKFVQS

SEQ ID NO: 4620 - protein, 9 aa, Homo Sapiens
KKATAFFPD

SEQ ID NO: 4621 - protein, 9 aa, Homo Sapiens
INGCCCLEE

SEQ ID NO: 4622 - protein, 9 aa, Homo Sapiens
LLEPLGLHC

SEQ ID NO: 4623 - protein, 9 aa, Homo Sapiens
VHCGTNVCR

SEQ ID NO: 4624 - protein, 9 aa, Homo Sapiens
RIVRVSLEH

SEQ ID NO: 4625 - protein, 9 aa, Homo Sapiens
IVRVSLEHP

SEQ ID NO: 4626 - protein, 9 aa, Homo Sapiens
LEHPTSAVC

SEQ ID NO: 4627 - protein, 9 aa, Homo Sapiens
LVDIYGSVP

SEQ ID NO: 4628 - protein, 9 aa, Homo Sapiens
VDIYGSVPE

SEQ ID NO: 4629 - protein, 9 aa, Homo Sapiens
EGTEMFEVY

SEQ ID NO: 4630 - protein, 9 aa, Homo Sapiens
MFEVYGTPG

SEQ ID NO: 4631 - protein, 9 aa, Homo Sapiens
YISPNMERG

SEQ ID NO: 4632 - protein, 9 aa, Homo Sapiens
RGRERADTR

SEQ ID NO: 4633 - protein, 9 aa, Homo Sapiens
ERADTRRWR

SEQ ID NO: 4634 - protein, 9 aa, Homo Sapiens
ADTRRWRFD

SEQ ID NO: 4635 - protein, 9 aa, Homo Sapiens
TLEIIVVMN

SEQ ID NO: 4636 - protein, 9 aa, Homo Sapiens
MNSPSNDLN

SEQ ID NO: 4637 - protein, 9 aa, Homo Sapiens
YHSSHEPLP

SEQ ID NO: 4638 - protein, 9 aa, Homo Sapiens
ISLDCDLNC

SEQ ID NO: 4639 - protein, 9 aa, Homo Sapiens
QDRNFVDKR

SEQ ID NO: 4640 - protein, 9 aa, Homo Sapiens
FVDKRQWVW

SEQ ID NO: 4641 - protein, 9 aa, Homo Sapiens
DKRQWVWGP

SEQ ID NO: 4642 - protein, 9 aa, Homo Sapiens
RQWVWGPSG

SEQ ID NO: 4643 - protein, 9 aa, Homo Sapiens
VWGPSGYGG

SEQ ID NO: 4644 - protein, 9 aa, Homo Sapiens
YGGILLVNC

SEQ ID NO: 4645 - protein, 9 aa, Homo Sapiens
SVMVLRTQG

SEQ ID NO: 4646 - protein, 9 aa, Homo Sapiens
FDDHKLVLH

SEQ ID NO: 4647 - protein, 9 aa, Homo Sapiens
HTSSYDAKR

SEQ ID NO: 4648 - protein, 9 aa, Homo Sapiens
DAKRAQVFH

SEQ ID NO: 4649 - protein, 9 aa, Homo Sapiens
KRAQVFHIC

SEQ ID NO: 4650 - protein, 9 aa, Homo Sapiens
CEAYRHVLG

SEQ ID NO: 4651 - protein, 9 aa, Homo Sapiens
HVLGQDKVS

SEQ ID NO: 4652 - protein, 9 aa, Homo Sapiens
VLGQDKVSY

SEQ ID NO: 4653 - protein, 9 aa, Homo Sapiens
DKVSYEVPR

SEQ ID NO: 4654 - protein, 9 aa, Homo Sapiens
DEERFFVEG

SEQ ID NO: 4655 - protein, 9 aa, Homo Sapiens
FVEGLSFPD

SEQ ID NO: 4656 - protein, 9 aa, Homo Sapiens
GFTGLISFH

SEQ ID NO: 4657 - protein, 9 aa, Homo Sapiens
TVVFRVAPW

SEQ ID NO: 4658 - protein, 9 aa, Homo Sapiens
RVAPWIMTP

SEQ ID NO: 4659 - protein, 9 aa, Homo Sapiens
TCFVDAVAE

SEQ ID NO: 4660 - protein, 9 aa, Homo Sapiens
KAGCKLTIC

SEQ ID NO: 4661 - protein, 9 aa, Homo Sapiens
DEMELGYVQ

SEQ ID NO: 4662 - protein, 9 aa, Homo Sapiens
VQAPHKTLP

SEQ ID NO: 4663 - protein, 9 aa, Homo Sapiens
KTLPVVFDS

SEQ ID NO: 4664 - protein, 9 aa, Homo Sapiens
RNGELQDFP

SEQ ID NO: 4665 - protein, 9 aa, Homo Sapiens
REPRDRSVS

SEQ ID NO: 4666 - protein, 9 aa, Homo Sapiens
RDRSVSGLD

SEQ ID NO: 4667 - protein, 9 aa, Homo Sapiens
DSFGNLEVS

SEQ ID NO: 4668 - protein, 9 aa, Homo Sapiens
SFGNLEVSP

SEQ ID NO: 4669 - protein, 9 aa, Homo Sapiens
VSPPVVANG

SEQ ID NO: 4670 - protein, 9 aa, Homo Sapiens
VVRDFLHAQ

SEQ ID NO: 4671 - protein, 9 aa, Homo Sapiens
FLHAQKVQP

SEQ ID NO: 4672 - protein, 9 aa, Homo Sapiens
LHAQKVQPP

SEQ ID NO: 4673 - protein, 9 aa, Homo Sapiens
FVDWLAVGH

SEQ ID NO: 4674 - protein, 9 aa, Homo Sapiens
DWLAVGHVD

SEQ ID NO: 4675 - protein, 9 aa, Homo Sapiens
WLAVGHVDE

SEQ ID NO: 4676 - protein, 9 aa, Homo Sapiens
GFRMLLASP

SEQ ID NO: 4677 - protein, 9 aa, Homo Sapiens
EKQKCGHGR

SEQ ID NO: 4678 - protein, 9 aa, Homo Sapiens
HGRALLFQG

SEQ ID NO: 4679 - protein, 9 aa, Homo Sapiens
LLFQGVVDD

SEQ ID NO: 4680 - protein, 9 aa, Homo Sapiens
LFQGVVDDE

SEQ ID NO: 4681 - protein, 9 aa, Homo Sapiens
IDWNREVLK

SEQ ID NO: 4682 - protein, 9 aa, Homo Sapiens
DWNREVLKR

SEQ ID NO: 4683 - protein, 9 aa, Homo Sapiens
RELGLAECD

SEQ ID NO: 4684 - protein, 9 aa, Homo Sapiens
ECDIIDIPQ

SEQ ID NO: 4685 - protein, 9 aa, Homo Sapiens
RKKATAFFP

SEQ ID NO: 4686 - protein, 9 aa, Homo Sapiens
LVNMLVLGK

SEQ ID NO: 4687 - protein, 9 aa, Homo Sapiens
IINGCCCLE

SEQ ID NO: 4688 - protein, 9 aa, Homo Sapiens
EEKVRSLLE

SEQ ID NO: 4689 - protein, 9 aa, Homo Sapiens
EKVRSLLEP

SEQ ID NO: 4690 - protein, 9 aa, Homo Sapiens
VRSLLEPLG

SEQ ID NO: 4691 - protein, 9 aa, Homo Sapiens
SLLEPLGLH

SEQ ID NO: 4692 - protein, 9 aa, Homo Sapiens
TFIDDFTPY

SEQ ID NO: 4693 - protein, 9 aa, Homo Sapiens
FIDDFTPYH

SEQ ID NO: 4694 - protein, 9 aa, Homo Sapiens
YHMLHGEVH

SEQ ID NO: 4695 - protein, 9 aa, Homo Sapiens
MLHGEVHCG

SEQ ID NO: 4696 - protein, 9 aa, Homo Sapiens
EVHCGTNVC

SEQ ID NO: 4697 - protein, 9 aa, Homo Sapiens
SLQRIVRVS

SEQ ID NO: 4698 - protein, 9 aa, Homo Sapiens
GTEMFEVYG

SEQ ID NO: 4699 - protein, 9 aa, Homo Sapiens
YGTPGVDIY

SEQ ID NO: 4700 - protein, 9 aa, Homo Sapiens
GVDIYISPN

SEQ ID NO: 4701 - protein, 9 aa, Homo Sapiens
PNMERGRER

SEQ ID NO: 4702 - protein, 9 aa, Homo Sapiens
IIVVMNSPS

SEQ ID NO: 4703 - protein, 9 aa, Homo Sapiens
IVVMNSPSN

SEQ ID NO: 4704 - protein, 9 aa, Homo Sapiens
NSPSNDLND

SEQ ID NO: 4705 - protein, 9 aa, Homo Sapiens
LNDSHVQIS

SEQ ID NO: 4706 - protein, 9 aa, Homo Sapiens
NDSHVQISY

SEQ ID NO: 4707 - protein, 9 aa, Homo Sapiens
QISYHSSHE

SEQ ID NO: 4708 - protein, 9 aa, Homo Sapiens
TCVDISLDC

SEQ ID NO: 4709 - protein, 9 aa, Homo Sapiens
DISLDCDLN

SEQ ID NO: 4710 - protein, 9 aa, Homo Sapiens
NCEGRQDRN

SEQ ID NO: 4711 - protein, 9 aa, Homo Sapiens
VDKRQWVWG

SEQ ID NO: 4712 - protein, 9 aa, Homo Sapiens
KRQWVWGPS

SEQ ID NO: 4713 - protein, 9 aa, Homo Sapiens
NCDRDDPSC

SEQ ID NO: 4714 - protein, 9 aa, Homo Sapiens
CDRDDPSCD

SEQ ID NO: 4715 - protein, 9 aa, Homo Sapiens
DDPSCDVQD

SEQ ID NO: 4716 - protein, 9 aa, Homo Sapiens
DNCDQHVHC

SEQ ID NO: 4717 - protein, 9 aa, Homo Sapiens
DQHVHCLQD

SEQ ID NO: 4718 - protein, 9 aa, Homo Sapiens
VHCLQDLED

SEQ ID NO: 4719 - protein, 9 aa, Homo Sapiens
KLVLHTSSY

SEQ ID NO: 4720 - protein, 9 aa, Homo Sapiens
AQVFHICGP

SEQ ID NO: 4721 - protein, 9 aa, Homo Sapiens
VFHICGPED

SEQ ID NO: 4722 - protein, 9 aa, Homo Sapiens
PEDVCEAYR

SEQ ID NO: 4723 - protein, 9 aa, Homo Sapiens
GDEERFFVE

SEQ ID NO: 4724 - protein, 9 aa, Homo Sapiens
EGLSFPDAG

SEQ ID NO: 4725 - protein, 9 aa, Homo Sapiens
SFHVTLLDD

SEQ ID NO: 4726 - protein, 9 aa, Homo Sapiens
LDDSNEDFS

SEQ ID NO: 4727 - protein, 9 aa, Homo Sapiens
DSNEDFSAS

SEQ ID NO: 4728 - protein, 9 aa, Homo Sapiens
VAPWIMTPS

SEQ ID NO: 4729 - protein, 9 aa, Homo Sapiens
VCRVRNNTC

SEQ ID NO: 4730 - protein, 9 aa, Homo Sapiens
DAVAELARK

SEQ ID NO: 4731 - protein, 9 aa, Homo Sapiens
VAELARKAG

SEQ ID NO: 4732 - protein, 9 aa, Homo Sapiens
ELARKAGCK

SEQ ID NO: 4733 - protein, 9 aa, Homo Sapiens
KLTICPQAE

SEQ ID NO: 4734 - protein, 9 aa, Homo Sapiens
PQAENRNDR

SEQ ID NO: 4735 - protein, 9 aa, Homo Sapiens
RNDRWIQDE

SEQ ID NO: 4736 - protein, 9 aa, Homo Sapiens
GELQDFPYK

SEQ ID NO: 4737 - protein, 9 aa, Homo Sapiens
KRILGPDFG

SEQ ID NO: 4738 - protein, 9 aa, Homo Sapiens
DFGYVTREP

SEQ ID NO: 4739 - protein, 9 aa, Homo Sapiens
FGYVTREPR

SEQ ID NO: 4740 - protein, 9 aa, Homo Sapiens
GLDSFGNLE

SEQ ID NO: 4741 - protein, 9 aa, Homo Sapiens
FGNLEVSPP

SEQ ID NO: 4742 - protein, 9 aa, Homo Sapiens
PVVANGKEY

SEQ ID NO: 4743 - protein, 9 aa, Homo Sapiens
NGKEYPLGR

SEQ ID NO: 4744 - protein, 9 aa, Homo Sapiens
LGRILIGGN

SEQ ID NO: 4745 - protein, 9 aa, Homo Sapiens
RILIGGNLP

SEQ ID NO: 4746 - protein, 9 aa, Homo Sapiens
IGGNLPGSS

SEQ ID NO: 4747 - protein, 9 aa, Homo Sapiens
NLPGSSGRR

SEQ ID NO: 4748 - protein, 9 aa, Homo Sapiens
VRDFLHAQK

SEQ ID NO: 4749 - protein, 9 aa, Homo Sapiens
LFVDWLAVG

SEQ ID NO: 4750 - protein, 9 aa, Homo Sapiens
FRMLLASPG

SEQ ID NO: 4751 - protein, 9 aa, Homo Sapiens
MLLASPGAC

SEQ ID NO: 4752 - protein, 9 aa, Homo Sapiens
EQVKTISIN

SEQ ID NO: 4753 - protein, 9 aa, Homo Sapiens
NYNKFVQSC

SEQ ID NO: 4754 - protein, 9 aa, Homo Sapiens
VQSCIDWNR

SEQ ID NO: 4755 - protein, 9 aa, Homo Sapiens
WNREVLKRE

SEQ ID NO: 4756 - protein, 9 aa, Homo Sapiens
REVLKRELG

SEQ ID NO: 4757 - protein, 9 aa, Homo Sapiens
KRELGLAEC

SEQ ID NO: 4758 - protein, 9 aa, Homo Sapiens
AECDIIDIP

SEQ ID NO: 4759 - protein, 9 aa, Homo Sapiens
DLVNMLVLG

SEQ ID NO: 4760 - protein, 9 aa, Homo Sapiens
VLGKHLGIP

SEQ ID NO: 4761 - protein, 9 aa, Homo Sapiens
LGKHLGIPK

SEQ ID NO: 4762 - protein, 9 aa, Homo Sapiens
PFGPIINGC

SEQ ID NO: 4763 - protein, 9 aa, Homo Sapiens
CCLEEKVRS

SEQ ID NO: 4764 - protein, 9 aa, Homo Sapiens
FTPYHMLHG

SEQ ID NO: 4765 - protein, 9 aa, Homo Sapiens
HMLHGEVHC

SEQ ID NO: 4766 - protein, 9 aa, Homo Sapiens
HCGTNVCRK

SEQ ID NO: 4767 - protein, 9 aa, Homo Sapiens
TNVCRKPFS

SEQ ID NO: 4768 - protein, 9 aa, Homo Sapiens
RKPFSFKWW

SEQ ID NO: 4769 - protein, 9 aa, Homo Sapiens
QRIVRVSLE

SEQ ID NO: 4770 - protein, 9 aa, Homo Sapiens
SAVCVAGVE

SEQ ID NO: 4771 - protein, 9 aa, Homo Sapiens
GVETLVDIY

SEQ ID NO: 4772 - protein, 9 aa, Homo Sapiens
ETLVDIYGS

SEQ ID NO: 4773 - protein, 9 aa, Homo Sapiens
EMFEVYGTP

SEQ ID NO: 4774 - protein, 9 aa, Homo Sapiens
ISPNMERGR

SEQ ID NO: 4775 - protein, 9 aa, Homo Sapiens
GRERADTRR

SEQ ID NO: 4776 - protein, 9 aa, Homo Sapiens
LEIIVVMNS

SEQ ID NO: 4777 - protein, 9 aa, Homo Sapiens
EIIVVMNSP

SEQ ID NO: 4778 - protein, 9 aa, Homo Sapiens
VVMNSPSND

SEQ ID NO: 4779 - protein, 9 aa, Homo Sapiens
NDLNDSHVQ

SEQ ID NO: 4780 - protein, 9 aa, Homo Sapiens
ISYHSSHEP

SEQ ID NO: 4781 - protein, 9 aa, Homo Sapiens
LYLTCVDIS

SEQ ID NO: 4782 - protein, 9 aa, Homo Sapiens
CVDISLDCD

SEQ ID NO: 4783 - protein, 9 aa, Homo Sapiens
SLDCDLNCE

SEQ ID NO: 4784 - protein, 9 aa, Homo Sapiens
DCDLNCEGR

SEQ ID NO: 4785 - protein, 9 aa, Homo Sapiens
DLNCEGRQD

SEQ ID NO: 4786 - protein, 9 aa, Homo Sapiens
LNCEGRQDR

SEQ ID NO: 4787 - protein, 9 aa, Homo Sapiens
GRQDRNFVD

SEQ ID NO: 4788 - protein, 9 aa, Homo Sapiens
RNFVDKRQW

SEQ ID NO: 4789 - protein, 9 aa, Homo Sapiens
GGILLVNCD

SEQ ID NO: 4790 - protein, 9 aa, Homo Sapiens
ILLVNCDRD

SEQ ID NO: 4791 - protein, 9 aa, Homo Sapiens
LVNCDRDDP

SEQ ID NO: 4792 - protein, 9 aa, Homo Sapiens
VNCDRDDPS

SEQ ID NO: 4793 - protein, 9 aa, Homo Sapiens
SCDVQDNCD

SEQ ID NO: 4794 - protein, 9 aa, Homo Sapiens
QDNCDQHVH

SEQ ID NO: 4795 - protein, 9 aa, Homo Sapiens
VMVLRTQGP

SEQ ID NO: 4796 - protein, 9 aa, Homo Sapiens
QGPAALFDD

SEQ ID NO: 4797 - protein, 9 aa, Homo Sapiens
PAALFDDHK

SEQ ID NO: 4798 - protein, 9 aa, Homo Sapiens
HKLVLHTSS

SEQ ID NO: 4799 - protein, 9 aa, Homo Sapiens
LHTSSYDAK

SEQ ID NO: 4800 - protein, 9 aa, Homo Sapiens
SSYDAKRAQ

SEQ ID NO: 4801 - protein, 9 aa, Homo Sapiens
RAQVFHICG

SEQ ID NO: 4802 - protein, 9 aa, Homo Sapiens
QVFHICGPE

SEQ ID NO: 4803 - protein, 9 aa, Homo Sapiens
EDVCEAYRH

SEQ ID NO: 4804 - protein, 9 aa, Homo Sapiens
YRHVLGQDK

SEQ ID NO: 4805 - protein, 9 aa, Homo Sapiens
LGQDKVSYE

SEQ ID NO: 4806 - protein, 9 aa, Homo Sapiens
QDKVSYEVP

SEQ ID NO: 4807 - protein, 9 aa, Homo Sapiens
YEVPRLHGD

SEQ ID NO: 4808 - protein, 9 aa, Homo Sapiens
EVPRLHGDE

SEQ ID NO: 4809 - protein, 9 aa, Homo Sapiens
ERFFVEGLS

SEQ ID NO: 4810 - protein, 9 aa, Homo Sapiens
FFVEGLSFP

SEQ ID NO: 4811 - protein, 9 aa, Homo Sapiens
SFPDAGFTG

SEQ ID NO: 4812 - protein, 9 aa, Homo Sapiens
SNEDFSASP

SEQ ID NO: 4813 - protein, 9 aa, Homo Sapiens
LEVYVCRVR

SEQ ID NO: 4814 - protein, 9 aa, Homo Sapiens
VYVCRVRNN

SEQ ID NO: 4815 - protein, 9 aa, Homo Sapiens
VRNNTCFVD

SEQ ID NO: 4816 - protein, 9 aa, Homo Sapiens
GCKLTICPQ

SEQ ID NO: 4817 - protein, 9 aa, Homo Sapiens
TICPQAENR

SEQ ID NO: 4818 - protein, 9 aa, Homo Sapiens
ICPQAENRN

SEQ ID NO: 4819 - protein, 9 aa, Homo Sapiens
LGYVQAPHK

SEQ ID NO: 4820 - protein, 9 aa, Homo Sapiens
TLPVVFDSP

SEQ ID NO: 4821 - protein, 9 aa, Homo Sapiens
PVVFDSPRN

SEQ ID NO: 4822 - protein, 9 aa, Homo Sapiens
DSPRNGELQ

SEQ ID NO: 4823 - protein, 9 aa, Homo Sapiens
NGELQDFPY

SEQ ID NO: 4824 - protein, 9 aa, Homo Sapiens
ELQDFPYKR

SEQ ID NO: 4825 - protein, 9 aa, Homo Sapiens
DFPYKRILG

SEQ ID NO: 4826 - protein, 9 aa, Homo Sapiens
PYKRILGPD

SEQ ID NO: 4827 - protein, 9 aa, Homo Sapiens
GYVTREPRD

SEQ ID NO: 4828 - protein, 9 aa, Homo Sapiens
VSGLDSFGN

SEQ ID NO: 4829 - protein, 9 aa, Homo Sapiens
VVANGKEYP

SEQ ID NO: 4830 - protein, 9 aa, Homo Sapiens
PLGRILIGG

SEQ ID NO: 4831 - protein, 9 aa, Homo Sapiens
GNLPGSSGR

SEQ ID NO: 4832 - protein, 9 aa, Homo Sapiens
DFLHAQKVQ

SEQ ID NO: 4833 - protein, 9 aa, Homo Sapiens
VDEFLSFVP

SEQ ID NO: 4834 - protein, 9 aa, Homo Sapiens
SFVPAPDGK

SEQ ID NO: 4835 - protein, 9 aa, Homo Sapiens
PAPDGKGFR

SEQ ID NO: 4836 - protein, 9 aa, Homo Sapiens
KLFQEKQKC

SEQ ID NO: 4837 - protein, 9 aa, Homo Sapiens
FQEKQKCGH

SEQ ID NO: 4838 - protein, 9 aa, Homo Sapiens
FQGVVDDEQ

SEQ ID NO: 4839 - protein, 9 aa, Homo Sapiens
GVVDDEQVK

SEQ ID NO: 4840 - protein, 9 aa, Homo Sapiens
DDEQVKTIS

SEQ ID NO: 4841 - protein, 9 aa, Homo Sapiens
INQVLSNKD

SEQ ID NO: 4842 - protein, 9 aa, Homo Sapiens
LSNKDLINY

SEQ ID NO: 4843 - protein, 9 aa, Homo Sapiens
NKDLINYNK

SEQ ID NO: 4844 - protein, 9 aa, Homo Sapiens
LINYNKFVQ

SEQ ID NO: 4845 - protein, 9 aa, Homo Sapiens
KFVQSCIDW

SEQ ID NO: 4846 - protein, 9 aa, Homo Sapiens
GLAECDIID

SEQ ID NO: 4847 - protein, 9 aa, Homo Sapiens
DIPQLFKTE

SEQ ID NO: 4848 - protein, 9 aa, Homo Sapiens
PQLFKTERK

SEQ ID NO: 4849 - protein, 9 aa, Homo Sapiens
QLFKTERKK

SEQ ID NO: 4850 - protein, 9 aa, Homo Sapiens
VNMLVLGKH

SEQ ID NO: 4851 - protein, 9 aa, Homo Sapiens
GKHLGIPKP

SEQ ID NO: 4852 - protein, 9 aa, Homo Sapiens
LGIPKPFGP

SEQ ID NO: 4853 - protein, 9 aa, Homo Sapiens
CCCLEEKVR

SEQ ID NO: 4854 - protein, 9 aa, Homo Sapiens
LGLHCTFID

SEQ ID NO: 4855 - protein, 9 aa, Homo Sapiens
GLHCTFIDD

SEQ ID NO: 4856 - protein, 9 aa, Homo Sapiens
DFTPYHMLH

SEQ ID NO: 4857 - protein, 9 aa, Homo Sapiens
CRKPFSFKW

SEQ ID NO: 4858 - protein, 9 aa, Homo Sapiens
SFKWWNMVP

SEQ ID NO: 4859 - protein, 9 aa, Homo Sapiens
APLEVYVCR

SEQ ID NO: 4860 - protein, 9 aa, Homo Sapiens
TPSTLAPLE

SEQ ID NO: 4861 - protein, 9 aa, Homo Sapiens
MTPSTLAPL

SEQ ID NO: 4862 - protein, 9 aa, Homo Sapiens
WIMTPSTLA

SEQ ID NO: 4863 - protein, 9 aa, Homo Sapiens
TLAPLEVYV

SEQ ID NO: 4864 - protein, 9 aa, Homo Sapiens
PSTLAPLEV

SEQ ID NO: 4865 - protein, 9 aa, Homo Sapiens
IMTPSTLAP

SEQ ID NO: 4866 - protein, 9 aa, Homo Sapiens
STLAPLEVY

SEQ ID NO: 4867 - protein, 9 aa, Homo Sapiens
LAPLEVYVC

SEQ ID NO: 4868 - protein, 9 aa, Homo Sapiens
VPDGKGFRM

SEQ ID NO: 4869 - protein, 9 aa, Homo Sapiens
VPVPDGKGF

SEQ ID NO: 4870 - protein, 9 aa, Homo Sapiens
DEFLSFVPV

SEQ ID NO: 4871 - protein, 9 aa, Homo Sapiens
FLSFVPVPD

SEQ ID NO: 4872 - protein, 9 aa, Homo Sapiens
LSFVPVPDG

SEQ ID NO: 4873 - protein, 9 aa, Homo Sapiens
EFLSFVPVP

SEQ ID NO: 4874 - protein, 9 aa, Homo Sapiens
FVPVPDGKG

SEQ ID NO: 4875 - protein, 9 aa, Homo Sapiens
SFVPVPDGK

SEQ ID NO: 4876 - protein, 9 aa, Homo Sapiens
PVPDGKGFR

SEQ ID NO: 4877 - protein, 9 aa, Homo Sapiens
CLEEKVRSL

SEQ ID NO: 4878 - protein, 9 aa, Homo Sapiens
VANGKEYPL

SEQ ID NO: 4879 - protein, 9 aa, Homo Sapiens
EPRDRSVSG

SEQ ID NO: 4880 - protein, 9 aa, Homo Sapiens
TERKKATAF

SEQ ID NO: 4881 - protein, 9 aa, Homo Sapiens
IPKPFGPII

SEQ ID NO: 4882 - protein, 9 aa, Homo Sapiens
FDSPRNGEL

SEQ ID NO: 4883 - protein, 9 aa, Homo Sapiens
EEKVRSLLE

SEQ ID NO: 4884 - protein, 9 aa, Homo Sapiens
LARKAGCKL

SEQ ID NO: 4885 - protein, 9 aa, Homo Sapiens
DGKGFRMLL

SEQ ID NO: 4886 - protein, 9 aa, Homo Sapiens
QEKQKCGHG

SEQ ID NO: 4887 - protein, 9 aa, Homo Sapiens
EVLKRELGL

SEQ ID NO: 4888 - protein, 9 aa, Homo Sapiens
EERFFVEGL

SEQ ID NO: 4889 - protein, 9 aa, Homo Sapiens
RADTRRWRF

SEQ ID NO: 4890 - protein, 9 aa, Homo Sapiens
PLAYAVLYL

SEQ ID NO: 4891 - protein, 9 aa, Homo Sapiens
GLISFHVTL

SEQ ID NO: 4892 - protein, 9 aa, Homo Sapiens
ELARKAGCK

SEQ ID NO: 4893 - protein, 9 aa, Homo Sapiens
ERKKATAFF

SEQ ID NO: 4894 - protein, 9 aa, Homo Sapiens
LQRIVRVSL

SEQ ID NO: 4895 - protein, 9 aa, Homo Sapiens
PLPLAYAVL

SEQ ID NO: 4896 - protein, 9 aa, Homo Sapiens
GPSGYGGIL

SEQ ID NO: 4897 - protein, 9 aa, Homo Sapiens
FPDAGFTGL

SEQ ID NO: 4898 - protein, 9 aa, Homo Sapiens
VCRVRNNTC

SEQ ID NO: 4899 - protein, 9 aa, Homo Sapiens
PHKTLPVVF

SEQ ID NO: 4900 - protein, 9 aa, Homo Sapiens
DEQVKTISI

SEQ ID NO: 4901 - protein, 9 aa, Homo Sapiens
VLSNKDLIN

SEQ ID NO: 4902 - protein, 9 aa, Homo Sapiens
VLKRELGLA

SEQ ID NO: 4903 - protein, 9 aa, Homo Sapiens
RGRERADTR

SEQ ID NO: 4904 - protein, 9 aa, Homo Sapiens
YLTCVDISL

SEQ ID NO: 4905 - protein, 9 aa, Homo Sapiens
FPYKRILGP

SEQ ID NO: 4906 - protein, 9 aa, Homo Sapiens
APDGKGFRM

SEQ ID NO: 4907 - protein, 9 aa, Homo Sapiens
YNKFVQSCI

SEQ ID NO: 4908 - protein, 9 aa, Homo Sapiens
LVLGKHLGI

SEQ ID NO: 4909 - protein, 9 aa, Homo Sapiens
KVRSLLEPL

SEQ ID NO: 4910 - protein, 9 aa, Homo Sapiens
NVCRKPFSF

SEQ ID NO: 4911 - protein, 9 aa, Homo Sapiens
MERGRERAD

SEQ ID NO: 4912 - protein, 9 aa, Homo Sapiens
TRRWRFDAT

SEQ ID NO: 4913 - protein, 9 aa, Homo Sapiens
VLYLTCVDI

SEQ ID NO: 4914 - protein, 9 aa, Homo Sapiens
DAKRAQVFH

SEQ ID NO: 4915 - protein, 9 aa, Homo Sapiens
VPRLHGDEE

SEQ ID NO: 4916 - protein, 9 aa, Homo Sapiens
LISFHVTLL

SEQ ID NO: 4917 - protein, 9 aa, Homo Sapiens
YPLGRILIG

SEQ ID NO: 4918 - protein, 9 aa, Homo Sapiens
SPGACFKLF

SEQ ID NO: 4919 - protein, 9 aa, Homo Sapiens
GACFKLFQE

SEQ ID NO: 4920 - protein, 9 aa, Homo Sapiens
ELGLAECDI

SEQ ID NO: 4921 - protein, 9 aa, Homo Sapiens
VLRTQGPAA

SEQ ID NO: 4922 - protein, 9 aa, Homo Sapiens
AALFDDHKL

SEQ ID NO: 4923 - protein, 9 aa, Homo Sapiens
YDAKRAQVF

SEQ ID NO: 4924 - protein, 9 aa, Homo Sapiens
KAGCKLTIC

SEQ ID NO: 4925 - protein, 9 aa, Homo Sapiens
QAPHKTLPV

SEQ ID NO: 4926 - protein, 9 aa, Homo Sapiens
SPRNGELQD

SEQ ID NO: 4927 - protein, 9 aa, Homo Sapiens
VPAPDGKGF

SEQ ID NO: 4928 - protein, 9 aa, Homo Sapiens
CGHGRALLF

SEQ ID NO: 4929 - protein, 9 aa, Homo Sapiens
CIDWNREVL

SEQ ID NO: 4930 - protein, 9 aa, Homo Sapiens
KATAFFPDL

SEQ ID NO: 4931 - protein, 9 aa, Homo Sapiens
PIINGCCCL

SEQ ID NO: 4932 - protein, 9 aa, Homo Sapiens
EPLGLHCTF

SEQ ID NO: 4933 - protein, 9 aa, Homo Sapiens
DLNDSHVQI

SEQ ID NO: 4934 - protein, 9 aa, Homo Sapiens
AKRAQVFHI

SEQ ID NO: 4935 - protein, 9 aa, Homo Sapiens
GLSFPDAGF

SEQ ID NO: 4936 - protein, 9 aa, Homo Sapiens
LLDDSNEDF

SEQ ID NO: 4937 - protein, 9 aa, Homo Sapiens
GCKLTICPQ

SEQ ID NO: 4938 - protein, 9 aa, Homo Sapiens
QAENRNDRW

SEQ ID NO: 4939 - protein, 9 aa, Homo Sapiens
LFQEKQKCG

SEQ ID NO: 4940 - protein, 9 aa, Homo Sapiens
NQVLSNKDL

SEQ ID NO: 4941 - protein, 9 aa, Homo Sapiens
SNKDLINYN

SEQ ID NO: 4942 - protein, 9 aa, Homo Sapiens
FKTERKKAT

SEQ ID NO: 4943 - protein, 9 aa, Homo Sapiens
PLGLHCTFI

SEQ ID NO: 4944 - protein, 9 aa, Homo Sapiens
SFKWWNMVP

SEQ ID NO: 4945 - protein, 9 aa, Homo Sapiens
VCVAGVETL

SEQ ID NO: 4946 - protein, 9 aa, Homo Sapiens
SYHSSHEPL

SEQ ID NO: 4947 - protein, 9 aa, Homo Sapiens
VDKRQWVWG

SEQ ID NO: 4948 - protein, 9 aa, Homo Sapiens
FDDHKLVLH

SEQ ID NO: 4949 - protein, 9 aa, Homo Sapiens
SYDAKRAQV

SEQ ID NO: 4950 - protein, 9 aa, Homo Sapiens
KVSYEVPRL

SEQ ID NO: 4951 - protein, 9 aa, Homo Sapiens
RLHGDEERF

SEQ ID NO: 4952 - protein, 9 aa, Homo Sapiens
CFVDAVAEL

SEQ ID NO: 4953 - protein, 9 aa, Homo Sapiens
YKRILGPDF

SEQ ID NO: 4954 - protein, 9 aa, Homo Sapiens
SGLDSFGNL

SEQ ID NO: 4955 - protein, 9 aa, Homo Sapiens
NGKEYPLGR

SEQ ID NO: 4956 - protein, 9 aa, Homo Sapiens
GRILIGGNL

SEQ ID NO: 4957 - protein, 9 aa, Homo Sapiens
VTQVVRDFL

SEQ ID NO: 4958 - protein, 9 aa, Homo Sapiens
QKVQPPVEL

SEQ ID NO: 4959 - protein, 9 aa, Homo Sapiens
PVELFVDWL

SEQ ID NO: 4960 - protein, 9 aa, Homo Sapiens
LAVGHVDEF

SEQ ID NO: 4961 - protein, 9 aa, Homo Sapiens
LLASPGACF

SEQ ID NO: 4962 - protein, 9 aa, Homo Sapiens
INYNKFVQS

SEQ ID NO: 4963 - protein, 9 aa, Homo Sapiens
NREVLKREL

SEQ ID NO: 4964 - protein, 9 aa, Homo Sapiens
FFPDLVNML

SEQ ID NO: 4965 - protein, 9 aa, Homo Sapiens
NMLVLGKHL

SEQ ID NO: 4966 - protein, 9 aa, Homo Sapiens
PNMERGRER

SEQ ID NO: 4967 - protein, 9 aa, Homo Sapiens
VMNSPSNDL

SEQ ID NO: 4968 - protein, 9 aa, Homo Sapiens
HSSHEPLPL

SEQ ID NO: 4969 - protein, 9 aa, Homo Sapiens
VDISLDCDL

SEQ ID NO: 4970 - protein, 9 aa, Homo Sapiens
PSGYGGILL

SEQ ID NO: 4971 - protein, 9 aa, Homo Sapiens
NCDQHVHCL

SEQ ID NO: 4972 - protein, 9 aa, Homo Sapiens
LEDMSVMVL

SEQ ID NO: 4973 - protein, 9 aa, Homo Sapiens
LRTQGPAAL

SEQ ID NO: 4974 - protein, 9 aa, Homo Sapiens
DHKLVLHTS

SEQ ID NO: 4975 - protein, 9 aa, Homo Sapiens
VCEAYRHVL

SEQ ID NO: 4976 - protein, 9 aa, Homo Sapiens
LGQDKVSYE

SEQ ID NO: 4977 - protein, 9 aa, Homo Sapiens
QDKVSYEVP

SEQ ID NO: 4978 - protein, 9 aa, Homo Sapiens
GDEERFFVE

SEQ ID NO: 4979 - protein, 9 aa, Homo Sapiens
PIFTDTVVF

SEQ ID NO: 4980 - protein, 9 aa, Homo Sapiens
ARKAGCKLT

SEQ ID NO: 4981 - protein, 9 aa, Homo Sapiens
RWIQDEMEL

SEQ ID NO: 4982 - protein, 9 aa, Homo Sapiens
YVQAPHKTL

SEQ ID NO: 4983 - protein, 9 aa, Homo Sapiens
DFPYKRILG

SEQ ID NO: 4984 - protein, 9 aa, Homo Sapiens
PRDRSVSGL

SEQ ID NO: 4985 - protein, 9 aa, Homo Sapiens
SSGRRVTQV

SEQ ID NO: 4986 - protein, 9 aa, Homo Sapiens
LHAQKVQPP

SEQ ID NO: 4987 - protein, 9 aa, Homo Sapiens
AQKVQPPVE

SEQ ID NO: 4988 - protein, 9 aa, Homo Sapiens
CFKLFQEKQ

SEQ ID NO: 4989 - protein, 9 aa, Homo Sapiens
QKCGHGRAL

SEQ ID NO: 4990 - protein, 9 aa, Homo Sapiens
VDDEQVKTI

SEQ ID NO: 4991 - protein, 9 aa, Homo Sapiens
KTISINQVL

SEQ ID NO: 4992 - protein, 9 aa, Homo Sapiens
REVLKRELG

SEQ ID NO: 4993 - protein, 9 aa, Homo Sapiens
LAECDIIDI

SEQ ID NO: 4994 - protein, 9 aa, Homo Sapiens
CDIIDIPQL

SEQ ID NO: 4995 - protein, 9 aa, Homo Sapiens
LFKTERKKA

SEQ ID NO: 4996 - protein, 9 aa, Homo Sapiens
PDLVNMLVL

SEQ ID NO: 4997 - protein, 9 aa, Homo Sapiens
GIPKPFGPI

SEQ ID NO: 4998 - protein, 9 aa, Homo Sapiens
RSLLEPLGL

SEQ ID NO: 4999 - protein, 9 aa, Homo Sapiens
MSLQRIVRV

SEQ ID NO: 5000 - protein, 9 aa, Homo Sapiens
QRIVRVSLE

SEQ ID NO: 5001 - protein, 9 aa, Homo Sapiens
SVPEGTEMF

SEQ ID NO: 5002 - protein, 9 aa, Homo Sapiens
RRWRFDATL

SEQ ID NO: 5003 - protein, 9 aa, Homo Sapiens
GRQDRNFVD

SEQ ID NO: 5004 - protein, 9 aa, Homo Sapiens
NFVDKRQWV

SEQ ID NO: 5005 - protein, 9 aa, Homo Sapiens
QHVHCLQDL

SEQ ID NO: 5006 - protein, 9 aa, Homo Sapiens
VMVLRTQGP

SEQ ID NO: 5007 - protein, 9 aa, Homo Sapiens
LFDDHKLVL

SEQ ID NO: 5008 - protein, 9 aa, Homo Sapiens
CEAYRHVLG

SEQ ID NO: 5009 - protein, 9 aa, Homo Sapiens
PWIMTPSTL

SEQ ID NO: 5010 - protein, 9 aa, Homo Sapiens
MTPSTLPPL

SEQ ID NO: 5011 - protein, 9 aa, Homo Sapiens
VYVCRVRNN

SEQ ID NO: 5012 - protein, 9 aa, Homo Sapiens
QDFPYKRIL

SEQ ID NO: 5013 - protein, 9 aa, Homo Sapiens
PYKRILGPD

SEQ ID NO: 5014 - protein, 9 aa, Homo Sapiens
KEYPLGRIL

SEQ ID NO: 5015 - protein, 9 aa, Homo Sapiens
GSSGRRVTQ

SEQ ID NO: 5016 - protein, 9 aa, Homo Sapiens
ELFVDWLAV

SEQ ID NO: 5017 - protein, 9 aa, Homo Sapiens
AVGHVDEFL

SEQ ID NO: 5018 - protein, 9 aa, Homo Sapiens
PDGKGFRML

SEQ ID NO: 5019 - protein, 9 aa, Homo Sapiens
ASPGACFKL

SEQ ID NO: 5020 - protein, 9 aa, Homo Sapiens
KQKCGHGRA

SEQ ID NO: 5021 - protein, 9 aa, Homo Sapiens
KCGHGRALL

SEQ ID NO: 5022 - protein, 9 aa, Homo Sapiens
QVKTISINQ

SEQ ID NO: 5023 - protein, 9 aa, Homo Sapiens
IDWNREVLK

SEQ ID NO: 5024 - protein, 9 aa, Homo Sapiens
DIIDIPQLF

SEQ ID NO: 5025 - protein, 9 aa, Homo Sapiens
PQLFKTERK

SEQ ID NO: 5026 - protein, 9 aa, Homo Sapiens
KTERKKATA

SEQ ID NO: 5027 - protein, 9 aa, Homo Sapiens
RKKATAFFP

SEQ ID NO: 5028 - protein, 9 aa, Homo Sapiens
LGKHLGIPK

SEQ ID NO: 5029 - protein, 9 aa, Homo Sapiens
LGIPKPFGP

SEQ ID NO: 5030 - protein, 9 aa, Homo Sapiens
LEEKVRSLL

SEQ ID NO: 5031 - protein, 9 aa, Homo Sapiens
SLLEPLGLH

SEQ ID NO: 5032 - protein, 9 aa, Homo Sapiens
DDFTPYHML

SEQ ID NO: 5033 - protein, 9 aa, Homo Sapiens
CRKPFSFKW

SEQ ID NO: 5034 - protein, 9 aa, Homo Sapiens
PFSFKWWNM

SEQ ID NO: 5035 - protein, 9 aa, Homo Sapiens
SLQRIVRVS

SEQ ID NO: 5036 - protein, 9 aa, Homo Sapiens
SLEHPTSAV

SEQ ID NO: 5037 - protein, 9 aa, Homo Sapiens
AGVETLVDI

SEQ ID NO: 5038 - protein, 9 aa, Homo Sapiens
EPLPLAYAV

SEQ ID NO: 5039 - protein, 9 aa, Homo Sapiens
FVDKRQWVW

SEQ ID NO: 5040 - protein, 9 aa, Homo Sapiens
VNCDRDDPS

SEQ ID NO: 5041 - protein, 9 aa, Homo Sapiens
TVVFRVAPW

SEQ ID NO: 5042 - protein, 9 aa, Homo Sapiens
PPLEVYVCR

SEQ ID NO: 5043 - protein, 9 aa, Homo Sapiens
ELGYVQAPH

SEQ ID NO: 5044 - protein, 9 aa, Homo Sapiens
GYVTREPRD

SEQ ID NO: 5045 - protein, 9 aa, Homo Sapiens
VTREPRDRS

SEQ ID NO: 5046 - protein, 9 aa, Homo Sapiens
SPPVVANGK

SEQ ID NO: 5047 - protein, 9 aa, Homo Sapiens
EYPLGRILI

SEQ ID NO: 5048 - protein, 9 aa, Homo Sapiens
GRRVTQVVR

SEQ ID NO: 5049 - protein, 9 aa, Homo Sapiens
TQVVRDFLH

SEQ ID NO: 5050 - protein, 9 aa, Homo Sapiens
PPVELFVDW

SEQ ID NO: 5051 - protein, 9 aa, Homo Sapiens
GKGFRMLLA

SEQ ID NO: 5052 - protein, 9 aa, Homo Sapiens
WNREVLKRE

SEQ ID NO: 5053 - protein, 9 aa, Homo Sapiens
LKRELGLAE

SEQ ID NO: 5054 - protein, 9 aa, Homo Sapiens
GLAECDIID

SEQ ID NO: 5055 - protein, 9 aa, Homo Sapiens
IPQLFKTER

SEQ ID NO: 5056 - protein, 9 aa, Homo Sapiens
FPDLVNMLV

SEQ ID NO: 5057 - protein, 9 aa, Homo Sapiens
GTNVCRKPF

SEQ ID NO: 5058 - protein, 9 aa, Homo Sapiens
IVRVSLEHP

SEQ ID NO: 5059 - protein, 9 aa, Homo Sapiens
HPTSAVCVA

SEQ ID NO: 5060 - protein, 9 aa, Homo Sapiens
VYGTPGVDI

SEQ ID NO: 5061 - protein, 9 aa, Homo Sapiens
TPGVDIYIS

SEQ ID NO: 5062 - protein, 9 aa, Homo Sapiens
SPNMERGRE

SEQ ID NO: 5063 - protein, 9 aa, Homo Sapiens
ADTRRWRFD

SEQ ID NO: 5064 - protein, 9 aa, Homo Sapiens
TLEIIVVMN

SEQ ID NO: 5065 - protein, 9 aa, Homo Sapiens
SPSNDLNDS

SEQ ID NO: 5066 - protein, 9 aa, Homo Sapiens
SLDCDLNCE

SEQ ID NO: 5067 - protein, 9 aa, Homo Sapiens
NCEGRQDRN

SEQ ID NO: 5068 - protein, 9 aa, Homo Sapiens
EGRQDRNFV

SEQ ID NO: 5069 - protein, 9 aa, Homo Sapiens
ILLVNCDRD

SEQ ID NO: 5070 - protein, 9 aa, Homo Sapiens
GPEDVCEAY

SEQ ID NO: 5071 - protein, 9 aa, Homo Sapiens
VLGQDKVSY

SEQ ID NO: 5072 - protein, 9 aa, Homo Sapiens
YEVPRLHGD

SEQ ID NO: 5073 - protein, 9 aa, Homo Sapiens
EDFSASPIF

SEQ ID NO: 5074 - protein, 9 aa, Homo Sapiens
SPIFTDTVV

SEQ ID NO: 5075 - protein, 9 aa, Homo Sapiens
VFRVAPWIM

SEQ ID NO: 5076 - protein, 9 aa, Homo Sapiens
LPPLEVYVC

SEQ ID NO: 5077 - protein, 9 aa, Homo Sapiens
PLEVYVCRV

SEQ ID NO: 5078 - protein, 9 aa, Homo Sapiens
VAELARKAG

SEQ ID NO: 5079 - protein, 9 aa, Homo Sapiens
AELARKAGC

SEQ ID NO: 5080 - protein, 9 aa, Homo Sapiens
ENRNDRWIQ

SEQ ID NO: 5081 - protein, 9 aa, Homo Sapiens
NRNDRWIQD

SEQ ID NO: 5082 - protein, 9 aa, Homo Sapiens
ELQDFPYKR

SEQ ID NO: 5083 - protein, 9 aa, Homo Sapiens
GPDFGYVTR

SEQ ID NO: 5084 - protein, 9 aa, Homo Sapiens
TREPRDRSV

SEQ ID NO: 5085 - protein, 9 aa, Homo Sapiens
PPVVANGKE

SEQ ID NO: 5086 - protein, 9 aa, Homo Sapiens
GKEYPLGRI

SEQ ID NO: 5087 - protein, 9 aa, Homo Sapiens
ILIGGNLPG

SEQ ID NO: 5088 - protein, 9 aa, Homo Sapiens
SGRRVTQVV

SEQ ID NO: 5089 - protein, 9 aa, Homo Sapiens
VVRDFLHAQ

SEQ ID NO: 5090 - protein, 9 aa, Homo Sapiens
FLHAQKVQP

SEQ ID NO: 5091 - protein, 9 aa, Homo Sapiens
WLAVGHVDE

SEQ ID NO: 5092 - protein, 9 aa, Homo Sapiens
LLFQGVVDD

SEQ ID NO: 5093 - protein, 9 aa, Homo Sapiens
DLINYNKFV

SEQ ID NO: 5094 - protein, 9 aa, Homo Sapiens
TNVCRKPFS

SEQ ID NO: 5095 - protein, 9 aa, Homo Sapiens
VPEGTEMFE

SEQ ID NO: 5096 - protein, 9 aa, Homo Sapiens
GTPGVDIYI

SEQ ID NO: 5097 - protein, 9 aa, Homo Sapiens
WRFDATLEI

SEQ ID NO: 5098 - protein, 9 aa, Homo Sapiens
EIIVVMNSP

SEQ ID NO: 5099 - protein, 9 aa, Homo Sapiens
IIVVMNSPS

SEQ ID NO: 5100 - protein, 9 aa, Homo Sapiens
LPLAYAVLY

SEQ ID NO: 5101 - protein, 9 aa, Homo Sapiens
QDRNFVDKR

SEQ ID NO: 5102 - protein, 9 aa, Homo Sapiens
DKRQWVWGP

SEQ ID NO: 5103 - protein, 9 aa, Homo Sapiens
GILLVNCDR

SEQ ID NO: 5104 - protein, 9 aa, Homo Sapiens
DPSCDVQDN

SEQ ID NO: 5105 - protein, 9 aa, Homo Sapiens
DLEDMSVMV

SEQ ID NO: 5106 - protein, 9 aa, Homo Sapiens
GPAALFDDH

SEQ ID NO: 5107 - protein, 9 aa, Homo Sapiens
ALFDDHKLV

SEQ ID NO: 5108 - protein, 9 aa, Homo Sapiens
KLVLHTSSY

SEQ ID NO: 5109 - protein, 9 aa, Homo Sapiens
VLHTSSYDA

SEQ ID NO: 5110 - protein, 9 aa, Homo Sapiens
EAYRHVLGQ

SEQ ID NO: 5111 - protein, 9 aa, Homo Sapiens
RFFVEGLSF

SEQ ID NO: 5112 - protein, 9 aa, Homo Sapiens
TLLDDSNED

SEQ ID NO: 5113 - protein, 9 aa, Homo Sapiens
VVFRVAPWI

SEQ ID NO: 5114 - protein, 9 aa, Homo Sapiens
TLPPLEVYV

SEQ ID NO: 5115 - protein, 9 aa, Homo Sapiens
CRVRNNTCF

SEQ ID NO: 5116 - protein, 9 aa, Homo Sapiens
KLTICPQAE

SEQ ID NO: 5117 - protein, 9 aa, Homo Sapiens
CPQAENRND

SEQ ID NO: 5118 - protein, 9 aa, Homo Sapiens
NDRWIQDEM

SEQ ID NO: 5119 - protein, 9 aa, Homo Sapiens
TLPVVFDSP

SEQ ID NO: 5120 - protein, 9 aa, Homo Sapiens
LPVVFDSPR

SEQ ID NO: 5121 - protein, 9 aa, Homo Sapiens
LQDFPYKRI

SEQ ID NO: 5122 - protein, 9 aa, Homo Sapiens
ILGPDFGYV

SEQ ID NO: 5123 - protein, 9 aa, Homo Sapiens
GLDSFGNLE

SEQ ID NO: 5124 - protein, 9 aa, Homo Sapiens
NLEVSPPVV

SEQ ID NO: 5125 - protein, 9 aa, Homo Sapiens
LGRILIGGN

SEQ ID NO: 5126 - protein, 9 aa, Homo Sapiens
RVTQVVRDF

SEQ ID NO: 5127 - protein, 9 aa, Homo Sapiens
KVQPPVELF

SEQ ID NO: 5128 - protein, 9 aa, Homo Sapiens
QPPVELFVD

SEQ ID NO: 5129 - protein, 9 aa, Homo Sapiens
GHVDEFLSF

SEQ ID NO: 5130 - protein, 9 aa, Homo Sapiens
FLSFVPAPD

SEQ ID NO: 5131 - protein, 9 aa, Homo Sapiens
GFRMLLASP

SEQ ID NO: 5132 - protein, 9 aa, Homo Sapiens
MLLASPGAC

SEQ ID NO: 5133 - protein, 9 aa, Homo Sapiens
HGRALLFQG

SEQ ID NO: 5134 - protein, 9 aa, Homo Sapiens
ALLFQGVVD

SEQ ID NO: 5135 - protein, 9 aa, Homo Sapiens
DLVNMLVLG

SEQ ID NO: 5136 - protein, 9 aa, Homo Sapiens
MLVLGKHLG

SEQ ID NO: 5137 - protein, 9 aa, Homo Sapiens
VLGKHLGIP

SEQ ID NO: 5138 - protein, 9 aa, Homo Sapiens
KHLGIPKPF

SEQ ID NO: 5139 - protein, 9 aa, Homo Sapiens
HLGIPKPFG

SEQ ID NO: 5140 - protein, 9 aa, Homo Sapiens
KPFGPIING

SEQ ID NO: 5141 - protein, 9 aa, Homo Sapiens
GPIINGCCC

SEQ ID NO: 5142 - protein, 9 aa, Homo Sapiens
GLHCTFIDD

SEQ ID NO: 5143 - protein, 9 aa, Homo Sapiens
LHCTFIDDF

SEQ ID NO: 5144 - protein, 9 aa, Homo Sapiens
MLHGEVHCG

SEQ ID NO: 5145 - protein, 9 aa, Homo Sapiens
VCRKPFSFK

SEQ ID NO: 5146 - protein, 9 aa, Homo Sapiens
SAVCVAGVE

SEQ ID NO: 5147 - protein, 9 aa, Homo Sapiens
VAGVETLVD

SEQ ID NO: 5148 - protein, 9 aa, Homo Sapiens
TLVDIYGSV

SEQ ID NO: 5149 - protein, 9 aa, Homo Sapiens
DIYGSVPEG

SEQ ID NO: 5150 - protein, 9 aa, Homo Sapiens
RERADTRRW

SEQ ID NO: 5151 - protein, 9 aa, Homo Sapiens
DTRRWRFDA

SEQ ID NO: 5152 - protein, 9 aa, Homo Sapiens
RWRFDATLE

SEQ ID NO: 5153 - protein, 9 aa, Homo Sapiens
RFDATLEII

SEQ ID NO: 5154 - protein, 9 aa, Homo Sapiens
DATLEIIVV

SEQ ID NO: 5155 - protein, 9 aa, Homo Sapiens
DLNCEGRQD

SEQ ID NO: 5156 - protein, 9 aa, Homo Sapiens
CEGRQDRNF

SEQ ID NO: 5157 - protein, 9 aa, Homo Sapiens
WGPSGYGGI

SEQ ID NO: 5158 - protein, 9 aa, Homo Sapiens
LLVNCDRDD

SEQ ID NO: 5159 - protein, 9 aa, Homo Sapiens
CDRDDPSCD

SEQ ID NO: 5160 - protein, 9 aa, Homo Sapiens
CLQDLEDMS

SEQ ID NO: 5161 - protein, 9 aa, Homo Sapiens
RTQGPAALF

SEQ ID NO: 5162 - protein, 9 aa, Homo Sapiens
AYRHVLGQD

SEQ ID NO: 5163 - protein, 9 aa, Homo Sapiens
LHGDEERFF

SEQ ID NO: 5164 - protein, 9 aa, Homo Sapiens
PDAGFTGLI

SEQ ID NO: 5165 - protein, 9 aa, Homo Sapiens
AGFTGLISF

SEQ ID NO: 5166 - protein, 9 aa, Homo Sapiens
NEDFSASPI

SEQ ID NO: 5167 - protein, 9 aa, Homo Sapiens
SASPIFTDT

SEQ ID NO: 5168 - protein, 9 aa, Homo Sapiens
APWIMTPST

SEQ ID NO: 5169 - protein, 9 aa, Homo Sapiens
TPSTLPPLE

SEQ ID NO: 5170 - protein, 9 aa, Homo Sapiens
RVRNNTCFV

SEQ ID NO: 5171 - protein, 9 aa, Homo Sapiens
RKAGCKLTI

SEQ ID NO: 5172 - protein, 9 aa, Homo Sapiens
AENRNDRWI

SEQ ID NO: 5173 - protein, 9 aa, Homo Sapiens
APHKTLPVV

SEQ ID NO: 5174 - protein, 9 aa, Homo Sapiens
PRNGELQDF

SEQ ID NO: 5175 - protein, 9 aa, Homo Sapiens
RDRSVSGLD

SEQ ID NO: 5176 - protein, 9 aa, Homo Sapiens
RSVSGLDSF

SEQ ID NO: 5177 - protein, 9 aa, Homo Sapiens
PLGRILIGG

SEQ ID NO: 5178 - protein, 9 aa, Homo Sapiens
NLPGSSGRR

SEQ ID NO: 5179 - protein, 9 aa, Homo Sapiens
LPGSSGRRV

SEQ ID NO: 5180 - protein, 9 aa, Homo Sapiens
KLFQEKQKC

SEQ ID NO: 5181 - protein, 9 aa, Homo Sapiens
SINQVLSNK

SEQ ID NO: 5182 - protein, 9 aa, Homo Sapiens
QVLSNKDLI

SEQ ID NO: 5183 - protein, 9 aa, Homo Sapiens
KDLINYNKF

SEQ ID NO: 5184 - protein, 9 aa, Homo Sapiens
LGLAECDII

SEQ ID NO: 5185 - protein, 9 aa, Homo Sapiens
QLFKTERKK

SEQ ID NO: 5186 - protein, 9 aa, Homo Sapiens
LLEPLGLHC

SEQ ID NO: 5187 - protein, 9 aa, Homo Sapiens
TPYHMLHGE

SEQ ID NO: 5188 - protein, 9 aa, Homo Sapiens
KPFSFKWWN

SEQ ID NO: 5189 - protein, 9 aa, Homo Sapiens
RIVRVSLEH

SEQ ID NO: 5190 - protein, 9 aa, Homo Sapiens
QISYHSSHE

SEQ ID NO: 5191 - protein, 9 aa, Homo Sapiens
YAVLYLTCV

SEQ ID NO: 5192 - protein, 9 aa, Homo Sapiens
DISLDCDLN

SEQ ID NO: 5193 - protein, 9 aa, Homo Sapiens
PAALFDDHK

SEQ ID NO: 5194 - protein, 9 aa, Homo Sapiens
RAQVFHICG

SEQ ID NO: 5195 - protein, 9 aa, Homo Sapiens
HICGPEDVC

SEQ ID NO: 5196 - protein, 9 aa, Homo Sapiens
VAPWIMTPS

SEQ ID NO: 5197 - protein, 9 aa, Homo Sapiens
EVSPPVVAN

SEQ ID NO: 5198 - protein, 9 aa, Homo Sapiens
HAQKVQPPV

SEQ ID NO: 5199 - protein, 9 aa, Homo Sapiens
RALLFQGVV

SEQ ID NO: 5200 - protein, 9 aa, Homo Sapiens
TISINQVLS

SEQ ID NO: 5201 - protein, 9 aa, Homo Sapiens
LINYNKFVQ

SEQ ID NO: 5202 - protein, 9 aa, Homo Sapiens
IIDIPQLFK

SEQ ID NO: 5203 - protein, 9 aa, Homo Sapiens
DIPQLFKTE

SEQ ID NO: 5204 - protein, 9 aa, Homo Sapiens
IINGCCCLE

SEQ ID NO: 5205 - protein, 9 aa, Homo Sapiens
FIDDFTPYH

SEQ ID NO: 5206 - protein, 9 aa, Homo Sapiens
ETLVDIYGS

SEQ ID NO: 5207 - protein, 9 aa, Homo Sapiens
EGTEMFEVY

SEQ ID NO: 5208 - protein, 9 aa, Homo Sapiens
EMFEVYGTP

SEQ ID NO: 5209 - protein, 9 aa, Homo Sapiens
DIYISPNME

SEQ ID NO: 5210 - protein, 9 aa, Homo Sapiens
YISPNMERG

SEQ ID NO: 5211 - protein, 9 aa, Homo Sapiens
ATLEIIVVM

SEQ ID NO: 5212 - protein, 9 aa, Homo Sapiens
SSHEPLPLA

SEQ ID NO: 5213 - protein, 9 aa, Homo Sapiens
LAYAVLYLT

SEQ ID NO: 5214 - protein, 9 aa, Homo Sapiens
CGPEDVCEA

SEQ ID NO: 5215 - protein, 9 aa, Homo Sapiens
DAGFTGLIS

SEQ ID NO: 5216 - protein, 9 aa, Homo Sapiens
WIMTPSTLP

SEQ ID NO: 5217 - protein, 9 aa, Homo Sapiens
EVYVCRVRN

SEQ ID NO: 5218 - protein, 9 aa, Homo Sapiens
DAVAELARK

SEQ ID NO: 5219 - protein, 9 aa, Homo Sapiens
TICPQAENR

SEQ ID NO: 5220 - protein, 9 aa, Homo Sapiens
WIQDEMELG

SEQ ID NO: 5221 - protein, 9 aa, Homo Sapiens
EMELGYVQA

SEQ ID NO: 5222 - protein, 9 aa, Homo Sapiens
HKTLPVVFD

SEQ ID NO: 5223 - protein, 9 aa, Homo Sapiens
RILGPDFGY

SEQ ID NO: 5224 - protein, 9 aa, Homo Sapiens
RILIGGNLP

SEQ ID NO: 5225 - protein, 9 aa, Homo Sapiens
LIGGNLPGS

SEQ ID NO: 5226 - protein, 9 aa, Homo Sapiens
EFLSFVPAP

SEQ ID NO: 5227 - protein, 9 aa, Homo Sapiens
PAPDGKGFR

SEQ ID NO: 5228 - protein, 9 aa, Homo Sapiens
LASPGACFK

SEQ ID NO: 5229 - protein, 9 aa, Homo Sapiens
SCIDWNREV

SEQ ID NO: 5230 - protein, 9 aa, Homo Sapiens
TAFFPDLVN

SEQ ID NO: 5231 - protein, 9 aa, Homo Sapiens
VSLEHPTSA

SEQ ID NO: 5232 - protein, 9 aa, Homo Sapiens
EHPTSAVCV

SEQ ID NO: 5233 - protein, 9 aa, Homo Sapiens
AVCVAGVET

SEQ ID NO: 5234 - protein, 9 aa, Homo Sapiens
VDIYGSVPE

SEQ ID NO: 5235 - protein, 9 aa, Homo Sapiens
IYISPNMER

SEQ ID NO: 5236 - protein, 9 aa, Homo Sapiens
SNDLNDSHV

SEQ ID NO: 5237 - protein, 9 aa, Homo Sapiens
SHEPLPLAY

SEQ ID NO: 5238 - protein, 9 aa, Homo Sapiens
SGYGGILLV

SEQ ID NO: 5239 - protein, 9 aa, Homo Sapiens
GGILLVNCD

SEQ ID NO: 5240 - protein, 9 aa, Homo Sapiens
SCDVQDNCD

SEQ ID NO: 5241 - protein, 9 aa, Homo Sapiens
VHCLQDLED

SEQ ID NO: 5242 - protein, 9 aa, Homo Sapiens
EDMSVMVLR

SEQ ID NO: 5243 - protein, 9 aa, Homo Sapiens
SVMVLRTQG

SEQ ID NO: 5244 - protein, 9 aa, Homo Sapiens
SSYDAKRAQ

SEQ ID NO: 5245 - protein, 9 aa, Homo Sapiens
VSYEVPRLH

SEQ ID NO: 5246 - protein, 9 aa, Homo Sapiens
SYEVPRLHG

SEQ ID NO: 5247 - protein, 9 aa, Homo Sapiens
HGDEERFFV

SEQ ID NO: 5248 - protein, 9 aa, Homo Sapiens
FFVEGLSFP

SEQ ID NO: 5249 - protein, 9 aa, Homo Sapiens
EGLSFPDAG

SEQ ID NO: 5250 - protein, 9 aa, Homo Sapiens
SFHVTLLDD

SEQ ID NO: 5251 - protein, 9 aa, Homo Sapiens
DSNEDFSAS

SEQ ID NO: 5252 - protein, 9 aa, Homo Sapiens
IFTDTVVFR

SEQ ID NO: 5253 - protein, 9 aa, Homo Sapiens
DTVVFRVAP

SEQ ID NO: 5254 - protein, 9 aa, Homo Sapiens
TCFVDAVAE

SEQ ID NO: 5255 - protein, 9 aa, Homo Sapiens
VDAVAELAR

SEQ ID NO: 5256 - protein, 9 aa, Homo Sapiens
IQDEMELGY

SEQ ID NO: 5257 - protein, 9 aa, Homo Sapiens
SFGNLEVSP

SEQ ID NO: 5258 - protein, 9 aa, Homo Sapiens
FGNLEVSPP

SEQ ID NO: 5259 - protein, 9 aa, Homo Sapiens
GNLEVSPPV

SEQ ID NO: 5260 - protein, 9 aa, Homo Sapiens
VDWLAVGHV

SEQ ID NO: 5261 - protein, 9 aa, Homo Sapiens
HVDEFLSFV

SEQ ID NO: 5262 - protein, 9 aa, Homo Sapiens
FQGVVDDEQ

SEQ ID NO: 5263 - protein, 9 aa, Homo Sapiens
EQVKTISIN

SEQ ID NO: 5264 - protein, 9 aa, Homo Sapiens
GKHLGIPKP

SEQ ID NO: 5265 - protein, 9 aa, Homo Sapiens
CCLEEKVRS

SEQ ID NO: 5266 - protein, 9 aa, Homo Sapiens
EKVRSLLEP

SEQ ID NO: 5267 - protein, 9 aa, Homo Sapiens
VHCGTNVCR

SEQ ID NO: 5268 - protein, 9 aa, Homo Sapiens
PTSAVCVAG

SEQ ID NO: 5269 - protein, 9 aa, Homo Sapiens
TSAVCVAGV

SEQ ID NO: 5270 - protein, 9 aa, Homo Sapiens
GVETLVDIY

SEQ ID NO: 5271 - protein, 9 aa, Homo Sapiens
VETLVDIYG

SEQ ID NO: 5272 - protein, 9 aa, Homo Sapiens
GSVPEGTEM

SEQ ID NO: 5273 - protein, 9 aa, Homo Sapiens
GTEMFEVYG

SEQ ID NO: 5274 - protein, 9 aa, Homo Sapiens
FEVYGTPGV

SEQ ID NO: 5275 - protein, 9 aa, Homo Sapiens
EVYGTPGVD

SEQ ID NO: 5276 - protein, 9 aa, Homo Sapiens
GVDIYISPN

SEQ ID NO: 5277 - protein, 9 aa, Homo Sapiens
VDIYISPNM

SEQ ID NO: 5278 - protein, 9 aa, Homo Sapiens
ERGRERADT

SEQ ID NO: 5279 - protein, 9 aa, Homo Sapiens
ERADTRRWR

SEQ ID NO: 5280 - protein, 9 aa, Homo Sapiens
DSHVQISYH

SEQ ID NO: 5281 - protein, 9 aa, Homo Sapiens
SHVQISYHS

SEQ ID NO: 5282 - protein, 9 aa, Homo Sapiens
ISYHSSHEP

SEQ ID NO: 5283 - protein, 9 aa, Homo Sapiens
HEPLPLAYA

SEQ ID NO: 5284 - protein, 9 aa, Homo Sapiens
LTCVDISLD

SEQ ID NO: 5285 - protein, 9 aa, Homo Sapiens
LDCDLNCEG

SEQ ID NO: 5286 - protein, 9 aa, Homo Sapiens
LNCEGRQDR

SEQ ID NO: 5287 - protein, 9 aa, Homo Sapiens
QDLEDMSVM

SEQ ID NO: 5288 - protein, 9 aa, Homo Sapiens
DMSVMVLRT

SEQ ID NO: 5289 - protein, 9 aa, Homo Sapiens
HKLVLHTSS

SEQ ID NO: 5290 - protein, 9 aa, Homo Sapiens
TSSYDAKRA

SEQ ID NO: 5291 - protein, 9 aa, Homo Sapiens
VFHICGPED

SEQ ID NO: 5292 - protein, 9 aa, Homo Sapiens
ICGPEDVCE

SEQ ID NO: 5293 - protein, 9 aa, Homo Sapiens
EDVCEAYRH

SEQ ID NO: 5294 - protein, 9 aa, Homo Sapiens
DVCEAYRHV

SEQ ID NO: 5295 - protein, 9 aa, Homo Sapiens
HVLGQDKVS

SEQ ID NO: 5296 - protein, 9 aa, Homo Sapiens
GQDKVSYEV

SEQ ID NO: 5297 - protein, 9 aa, Homo Sapiens
EVPRLHGDE

SEQ ID NO: 5298 - protein, 9 aa, Homo Sapiens
DEERFFVEG

SEQ ID NO: 5299 - protein, 9 aa, Homo Sapiens
ERFFVEGLS

SEQ ID NO: 5300 - protein, 9 aa, Homo Sapiens
VEGLSFPDA

SEQ ID NO: 5301 - protein, 9 aa, Homo Sapiens
SFPDAGFTG

SEQ ID NO: 5302 - protein, 9 aa, Homo Sapiens
GFTGLISFH

SEQ ID NO: 5303 - protein, 9 aa, Homo Sapiens
FTGLISFHV

SEQ ID NO: 5304 - protein, 9 aa, Homo Sapiens
HVTLLDDSN

SEQ ID NO: 5305 - protein, 9 aa, Homo Sapiens
VTLLDDSNE

SEQ ID NO: 5306 - protein, 9 aa, Homo Sapiens
SNEDFSASP

SEQ ID NO: 5307 - protein, 9 aa, Homo Sapiens
FSASPIFTD

SEQ ID NO: 5308 - protein, 9 aa, Homo Sapiens
FTDTVVFRV

SEQ ID NO: 5309 - protein, 9 aa, Homo Sapiens
PSTLPPLEV

SEQ ID NO: 5310 - protein, 9 aa, Homo Sapiens
STLPPLEVY

SEQ ID NO: 5311 - protein, 9 aa, Homo Sapiens
NNTCFVDAV

SEQ ID NO: 5312 - protein, 9 aa, Homo Sapiens
AVAELARKA

SEQ ID NO: 5313 - protein, 9 aa, Homo Sapiens
PQAENRNDR

SEQ ID NO: 5314 - protein, 9 aa, Homo Sapiens
DEMELGYVQ

SEQ ID NO: 5315 - protein, 9 aa, Homo Sapiens
MELGYVQAP

SEQ ID NO: 5316 - protein, 9 aa, Homo Sapiens
RNGELQDFP

SEQ ID NO: 5317 - protein, 9 aa, Homo Sapiens
DFGYVTREP

SEQ ID NO: 5318 - protein, 9 aa, Homo Sapiens
FGYVTREPR

SEQ ID NO: 5319 - protein, 9 aa, Homo Sapiens
SVSGLDSFG

SEQ ID NO: 5320 - protein, 9 aa, Homo Sapiens
VSGLDSFGN

SEQ ID NO: 5321 - protein, 9 aa, Homo Sapiens
LDSFGNLEV

SEQ ID NO: 5322 - protein, 9 aa, Homo Sapiens
VSPPVVANG

SEQ ID NO: 5323 - protein, 9 aa, Homo Sapiens
PVVANGKEY

SEQ ID NO: 5324 - protein, 9 aa, Homo Sapiens
GGNLPGSSG

SEQ ID NO: 5325 - protein, 9 aa, Homo Sapiens
RRVTQVVRD

SEQ ID NO: 5326 - protein, 9 aa, Homo Sapiens
FVDWLAVGH

SEQ ID NO: 5327 - protein, 9 aa, Homo Sapiens
VGHVDEFLS

SEQ ID NO: 5328 - protein, 9 aa, Homo Sapiens
DEFLSFVPA

SEQ ID NO: 5329 - protein, 9 aa, Homo Sapiens
SFVPAPDGK

SEQ ID NO: 5330 - protein, 9 aa, Homo Sapiens
FRMLLASPG

SEQ ID NO: 5331 - protein, 9 aa, Homo Sapiens
FKLFQEKQK

SEQ ID NO: 5332 - protein, 9 aa, Homo Sapiens
EKQKCGHGR

SEQ ID NO: 5333 - protein, 9 aa, Homo Sapiens
GRALLFQGV

SEQ ID NO: 5334 - protein, 9 aa, Homo Sapiens
VVDDEQVKT

SEQ ID NO: 5335 - protein, 9 aa, Homo Sapiens
VKTISINQV

SEQ ID NO: 5336 - protein, 9 aa, Homo Sapiens
ISINQVLSN

SEQ ID NO: 5337 - protein, 9 aa, Homo Sapiens
INQVLSNKD

SEQ ID NO: 5338 - protein, 9 aa, Homo Sapiens
NKDLINYNK

SEQ ID NO: 5339 - protein, 9 aa, Homo Sapiens
FVQSCIDWN

SEQ ID NO: 5340 - protein, 9 aa, Homo Sapiens
KRELGLAEC

SEQ ID NO: 5341 - protein, 9 aa, Homo Sapiens
ECDIIDIPQ

SEQ ID NO: 5342 - protein, 9 aa, Homo Sapiens
VNMLVLGKH

SEQ ID NO: 5343 - protein, 9 aa, Homo Sapiens
FGPIINGCC

SEQ ID NO: 5344 - protein, 9 aa, Homo Sapiens
INGCCCLEE

SEQ ID NO: 5345 - protein, 9 aa, Homo Sapiens
CCCLEEKVR

SEQ ID NO: 5346 - protein, 9 aa, Homo Sapiens
VRSLLEPLG

SEQ ID NO: 5347 - protein, 9 aa, Homo Sapiens
FTPYHMLHG

SEQ ID NO: 5348 - protein, 9 aa, Homo Sapiens
HMLHGEVHC

SEQ ID NO: 5349 - protein, 9 aa, Homo Sapiens
LHGEVHCGT

SEQ ID NO: 5350 - protein, 9 aa, Homo Sapiens
HGEVHCGTN

SEQ ID NO: 5351 - protein, 9 aa, Homo Sapiens
EVHCGTNVC

SEQ ID NO: 5352 - protein, 9 aa, Homo Sapiens
HCGTNVCRK

SEQ ID NO: 5353 - protein, 9 aa, Homo Sapiens
VRVSLEHPT

SEQ ID NO: 5354 - protein, 9 aa, Homo Sapiens
RVSLEHPTS

SEQ ID NO: 5355 - protein, 9 aa, Homo Sapiens
IYGSVPEGT

SEQ ID NO: 5356 - protein, 9 aa, Homo Sapiens
YGSVPEGTE

SEQ ID NO: 5357 - protein, 9 aa, Homo Sapiens
PEGTEMFEV

SEQ ID NO: 5358 - protein, 9 aa, Homo Sapiens
TEMFEVYGT

SEQ ID NO: 5359 - protein, 9 aa, Homo Sapiens
MFEVYGTPG

SEQ ID NO: 5360 - protein, 9 aa, Homo Sapiens
YGTPGVDIY

SEQ ID NO: 5361 - protein, 9 aa, Homo Sapiens
ISPNMERGR

SEQ ID NO: 5362 - protein, 9 aa, Homo Sapiens
GRERADTRR

SEQ ID NO: 5363 - protein, 9 aa, Homo Sapiens
FDATLEIIV

SEQ ID NO: 5364 - protein, 9 aa, Homo Sapiens
LEIIVVMNS

SEQ ID NO: 5365 - protein, 9 aa, Homo Sapiens
IVVMNSPSN

SEQ ID NO: 5366 - protein, 9 aa, Homo Sapiens
VVMNSPSND

SEQ ID NO: 5367 - protein, 9 aa, Homo Sapiens
MNSPSNDLN

SEQ ID NO: 5368 - protein, 9 aa, Homo Sapiens
PSNDLNDSH

SEQ ID NO: 5369 - protein, 9 aa, Homo Sapiens
LNDSHVQIS

SEQ ID NO: 5370 - protein, 9 aa, Homo Sapiens
HVQISYHSS

SEQ ID NO: 5371 - protein, 9 aa, Homo Sapiens
VQISYHSSH

SEQ ID NO: 5372 - protein, 9 aa, Homo Sapiens
AYAVLYLTC

SEQ ID NO: 5373 - protein, 9 aa, Homo Sapiens
AVLYLTCVD

SEQ ID NO: 5374 - protein, 9 aa, Homo Sapiens
LYLTCVDIS

SEQ ID NO: 5375 - protein, 9 aa, Homo Sapiens
ISLDCDLNC

SEQ ID NO: 5376 - protein, 9 aa, Homo Sapiens
DCDLNCEGR

SEQ ID NO: 5377 - protein, 9 aa, Homo Sapiens
RQDRNFVDK

SEQ ID NO: 5378 - protein, 9 aa, Homo Sapiens
DRNFVDKRQ

SEQ ID NO: 5379 - protein, 9 aa, Homo Sapiens
RNFVDKRQW

SEQ ID NO: 5380 - protein, 9 aa, Homo Sapiens
RQWVWGPSG

SEQ ID NO: 5381 - protein, 9 aa, Homo Sapiens
VWGPSGYGG

SEQ ID NO: 5382 - protein, 9 aa, Homo Sapiens
GYGGILLVN

SEQ ID NO: 5383 - protein, 9 aa, Homo Sapiens
YGGILLVNC

SEQ ID NO: 5384 - protein, 9 aa, Homo Sapiens
DDPSCDVQD

SEQ ID NO: 5385 - protein, 9 aa, Homo Sapiens
CDVQDNCDQ

SEQ ID NO: 5386 - protein, 9 aa, Homo Sapiens
VQDNCDQHV

SEQ ID NO: 5387 - protein, 9 aa, Homo Sapiens
DNCDQHVHC

SEQ ID NO: 5388 - protein, 9 aa, Homo Sapiens
DQHVHCLQD

SEQ ID NO: 5389 - protein, 9 aa, Homo Sapiens
HVHCLQDLE

SEQ ID NO: 5390 - protein, 9 aa, Homo Sapiens
HCLQDLEDM

SEQ ID NO: 5391 - protein, 9 aa, Homo Sapiens
LQDLEDMSV

SEQ ID NO: 5392 - protein, 9 aa, Homo Sapiens
DDHKLVLHT

SEQ ID NO: 5393 - protein, 9 aa, Homo Sapiens
LHTSSYDAK

SEQ ID NO: 5394 - protein, 9 aa, Homo Sapiens
HTSSYDAKR

SEQ ID NO: 5395 - protein, 9 aa, Homo Sapiens
AQVFHICGP

SEQ ID NO: 5396 - protein, 9 aa, Homo Sapiens
FHICGPEDV

SEQ ID NO: 5397 - protein, 9 aa, Homo Sapiens
PEDVCEAYR

SEQ ID NO: 5398 - protein, 9 aa, Homo Sapiens
YRHVLGQDK

SEQ ID NO: 5399 - protein, 9 aa, Homo Sapiens
RHVLGQDKV

SEQ ID NO: 5400 - protein, 9 aa, Homo Sapiens
DKVSYEVPR

SEQ ID NO: 5401 - protein, 9 aa, Homo Sapiens
PRLHGDEER

SEQ ID NO: 5402 - protein, 9 aa, Homo Sapiens
FVEGLSFPD

SEQ ID NO: 5403 - protein, 9 aa, Homo Sapiens
ISFHVTLLD

SEQ ID NO: 5404 - protein, 9 aa, Homo Sapiens
FHVTLLDDS

SEQ ID NO: 5405 - protein, 9 aa, Homo Sapiens
TDTVVFRVA

SEQ ID NO: 5406 - protein, 9 aa, Homo Sapiens
FRVAPWIMT

SEQ ID NO: 5407 - protein, 9 aa, Homo Sapiens
RVAPWIMTP

SEQ ID NO: 5408 - protein, 9 aa, Homo Sapiens
IMTPSTLPP

SEQ ID NO: 5409 - protein, 9 aa, Homo Sapiens
LEVYVCRVR

SEQ ID NO: 5410 - protein, 9 aa, Homo Sapiens
VRNNTCFVD

SEQ ID NO: 5411 - protein, 9 aa, Homo Sapiens
RNNTCFVDA

SEQ ID NO: 5412 - protein, 9 aa, Homo Sapiens
FVDAVAELA

SEQ ID NO: 5413 - protein, 9 aa, Homo Sapiens
LTICPQAEN

SEQ ID NO: 5414 - protein, 9 aa, Homo Sapiens
ICPQAENRN

SEQ ID NO: 5415 - protein, 9 aa, Homo Sapiens
RNDRWIQDE

SEQ ID NO: 5416 - protein, 9 aa, Homo Sapiens
LGYVQAPHK

SEQ ID NO: 5417 - protein, 9 aa, Homo Sapiens
GYVQAPHKT

SEQ ID NO: 5418 - protein, 9 aa, Homo Sapiens
VQAPHKTLP

SEQ ID NO: 5419 - protein, 9 aa, Homo Sapiens
KTLPVVFDS

SEQ ID NO: 5420 - protein, 9 aa, Homo Sapiens
VVFDSPRNG

SEQ ID NO: 5421 - protein, 9 aa, Homo Sapiens
VFDSPRNGE

SEQ ID NO: 5422 - protein, 9 aa, Homo Sapiens
NGELQDFPY

SEQ ID NO: 5423 - protein, 9 aa, Homo Sapiens
GELQDFPYK

SEQ ID NO: 5424 - protein, 9 aa, Homo Sapiens
KRILGPDFG

SEQ ID NO: 5425 - protein, 9 aa, Homo Sapiens
PDFGYVTRE

SEQ ID NO: 5426 - protein, 9 aa, Homo Sapiens
DRSVSGLDS

SEQ ID NO: 5427 - protein, 9 aa, Homo Sapiens
LEVSPPVVA

SEQ ID NO: 5428 - protein, 9 aa, Homo Sapiens
VVANGKEYP

SEQ ID NO: 5429 - protein, 9 aa, Homo Sapiens
IGGNLPGSS

SEQ ID NO: 5430 - protein, 9 aa, Homo Sapiens
GNLPGSSGR

SEQ ID NO: 5431 - protein, 9 aa, Homo Sapiens
VRDFLHAQK

SEQ ID NO: 5432 - protein, 9 aa, Homo Sapiens
RDFLHAQKV

SEQ ID NO: 5433 - protein, 9 aa, Homo Sapiens
DFLHAQKVQ

SEQ ID NO: 5434 - protein, 9 aa, Homo Sapiens
VQPPVELFV

SEQ ID NO: 5435 - protein, 9 aa, Homo Sapiens
VELFVDWLA

SEQ ID NO: 5436 - protein, 9 aa, Homo Sapiens
VDEFLSFVP

SEQ ID NO: 5437 - protein, 9 aa, Homo Sapiens
LSFVPAPDG

SEQ ID NO: 5438 - protein, 9 aa, Homo Sapiens
FVPAPDGKG

SEQ ID NO: 5439 - protein, 9 aa, Homo Sapiens
KGFRMLLAS

SEQ ID NO: 5440 - protein, 9 aa, Homo Sapiens
RMLLASPGA

SEQ ID NO: 5441 - protein, 9 aa, Homo Sapiens
ACFKLFQEK

SEQ ID NO: 5442 - protein, 9 aa, Homo Sapiens
FQEKQKCGH

SEQ ID NO: 5443 - protein, 9 aa, Homo Sapiens
GHGRALLFQ

SEQ ID NO: 5444 - protein, 9 aa, Homo Sapiens
LFQGVVDDE

SEQ ID NO: 5445 - protein, 9 aa, Homo Sapiens
QGVVDDEQV

SEQ ID NO: 5446 - protein, 9 aa, Homo Sapiens
GVVDDEQVK

SEQ ID NO: 5447 - protein, 9 aa, Homo Sapiens
NYNKFVQSC

SEQ ID NO: 5448 - protein, 9 aa, Homo Sapiens
NKFVQSCID

SEQ ID NO: 5449 - protein, 9 aa, Homo Sapiens
VQSCIDWNR

SEQ ID NO: 5450 - protein, 9 aa, Homo Sapiens
DWNREVLKR

SEQ ID NO: 5451 - protein, 9 aa, Homo Sapiens
AECDIIDIP

SEQ ID NO: 5452 - protein, 9 aa, Homo Sapiens
IDIPQLFKT

SEQ ID NO: 5453 - protein, 9 aa, Homo Sapiens
AFFPDLVNM

SEQ ID NO: 5454 - protein, 9 aa, Homo Sapiens
LVNMLVLGK

SEQ ID NO: 5455 - protein, 9 aa, Homo Sapiens
PFGPIINGC

SEQ ID NO: 5456 - protein, 9 aa, Homo Sapiens
NGCCCLEEK

SEQ ID NO: 5457 - protein, 9 aa, Homo Sapiens
GCCCLEEKV

SEQ ID NO: 5458 - protein, 9 aa, Homo Sapiens
LEPLGLHCT

SEQ ID NO: 5459 - protein, 9 aa, Homo Sapiens
HCTFIDDFT

SEQ ID NO: 5460 - protein, 9 aa, Homo Sapiens
IDDFTPYHM

SEQ ID NO: 5461 - protein, 9 aa, Homo Sapiens
PYHMLHGEV

SEQ ID NO: 5462 - protein, 9 aa, Homo Sapiens
YHMLHGEVH

SEQ ID NO: 5463 - protein, 9 aa, Homo Sapiens
GEVHCGTNV

SEQ ID NO: 5464 - protein, 9 aa, Homo Sapiens
RKPFSFKWW

SEQ ID NO: 5465 - protein, 9 aa, Homo Sapiens
FSFKWWNMV

SEQ ID NO: 5466 - protein, 9 aa, Homo Sapiens
MTPSTLAPL

SEQ ID NO: 5467 - protein, 9 aa, Homo Sapiens
APLEVYVCR

SEQ ID NO: 5468 - protein, 9 aa, Homo Sapiens
TLAPLEVYV

SEQ ID NO: 5469 - protein, 9 aa, Homo Sapiens
TPSTLAPLE

SEQ ID NO: 5470 - protein, 9 aa, Homo Sapiens
LAPLEVYVC

SEQ ID NO: 5471 - protein, 9 aa, Homo Sapiens
WIMTPSTLA

SEQ ID NO: 5472 - protein, 9 aa, Homo Sapiens
IMTPSTLAP

SEQ ID NO: 5473 - protein, 9 aa, Homo Sapiens
PSTLAPLEV

SEQ ID NO: 5474 - protein, 9 aa, Homo Sapiens
STLAPLEVY

SEQ ID NO: 5475 - protein, 9 aa, Homo Sapiens
VPDGKGFRM

SEQ ID NO: 5476 - protein, 9 aa, Homo Sapiens
VPVPDGKGF

SEQ ID NO: 5477 - protein, 9 aa, Homo Sapiens
FLSFVPVPD

SEQ ID NO: 5478 - protein, 9 aa, Homo Sapiens
EFLSFVPVP

SEQ ID NO: 5479 - protein, 9 aa, Homo Sapiens
DEFLSFVPV

SEQ ID NO: 5480 - protein, 9 aa, Homo Sapiens
LSFVPVPDG

SEQ ID NO: 5481 - protein, 9 aa, Homo Sapiens
SFVPVPDGK

SEQ ID NO: 5482 - protein, 9 aa, Homo Sapiens
FVPVPDGKG

SEQ ID NO: 5483 - protein, 9 aa, Homo Sapiens
PHKTLPVVF

SEQ ID NO: 5484 - protein, 9 aa, Homo Sapiens
QHVHCLQDL

SEQ ID NO: 5485 - protein, 9 aa, Homo Sapiens
LHGDEERFF

SEQ ID NO: 5486 - protein, 9 aa, Homo Sapiens
GHVDEFLSF

SEQ ID NO: 5487 - protein, 9 aa, Homo Sapiens
KHLGIPKPF

SEQ ID NO: 5488 - protein, 9 aa, Homo Sapiens
LHCTFIDDF

SEQ ID NO: 5489 - protein, 9 aa, Homo Sapiens
QKVQPPVEL

SEQ ID NO: 5490 - protein, 9 aa, Homo Sapiens
NREVLKREL

SEQ ID NO: 5491 - protein, 9 aa, Homo Sapiens
SHEPLPLAY

SEQ ID NO: 5492 - protein, 9 aa, Homo Sapiens
KVSYEVPRL

SEQ ID NO: 5493 - protein, 9 aa, Homo Sapiens
QDFPYKRIL

SEQ ID NO: 5494 - protein, 9 aa, Homo Sapiens
PDLVNMLVL

SEQ ID NO: 5495 - protein, 9 aa, Homo Sapiens
CLEEKVRSL

SEQ ID NO: 5496 - protein, 9 aa, Homo Sapiens
LRTQGPAAL

SEQ ID NO: 5497 - protein, 9 aa, Homo Sapiens
LFDDHKLVL

SEQ ID NO: 5498 - protein, 9 aa, Homo Sapiens
VCEAYRHVL

SEQ ID NO: 5499 - protein, 9 aa, Homo Sapiens
GLISFHVTL

SEQ ID NO: 5500 - protein, 9 aa, Homo Sapiens
FDSPRNGEL

SEQ ID NO: 5501 - protein, 9 aa, Homo Sapiens
KEYPLGRIL

SEQ ID NO: 5502 - protein, 9 aa, Homo Sapiens
PDGKGFRML

SEQ ID NO: 5503 - protein, 9 aa, Homo Sapiens
QKCGHGRAL

SEQ ID NO: 5504 - protein, 9 aa, Homo Sapiens
CIDWNREVL

SEQ ID NO: 5505 - protein, 9 aa, Homo Sapiens
LQRIVRVSL

SEQ ID NO: 5506 - protein, 9 aa, Homo Sapiens
EHPTSAVCV

SEQ ID NO: 5507 - protein, 9 aa, Homo Sapiens
VCVAGVETL

SEQ ID NO: 5508 - protein, 9 aa, Homo Sapiens
YHSSHEPLP

SEQ ID NO: 5509 - protein, 9 aa, Homo Sapiens
GPSGYGGIL

SEQ ID NO: 5510 - protein, 9 aa, Homo Sapiens
LEDMSVMVL

SEQ ID NO: 5511 - protein, 9 aa, Homo Sapiens
CFVDAVAEL

SEQ ID NO: 5512 - protein, 9 aa, Homo Sapiens
YVQAPHKTL

SEQ ID NO: 5513 - protein, 9 aa, Homo Sapiens
LHAQKVQPP

SEQ ID NO: 5514 - protein, 9 aa, Homo Sapiens
LEEKVRSLL

SEQ ID NO: 5515 - protein, 9 aa, Homo Sapiens
YHMLHGEVH

SEQ ID NO: 5516 - protein, 9 aa, Homo Sapiens
VHCGTNVCR

SEQ ID NO: 5517 - protein, 9 aa, Homo Sapiens
ATLEIIVVM

SEQ ID NO: 5518 - protein, 9 aa, Homo Sapiens
HSSHEPLPL

SEQ ID NO: 5519 - protein, 9 aa, Homo Sapiens
PLPLAYAVL

SEQ ID NO: 5520 - protein, 9 aa, Homo Sapiens
PLAYAVLYL

SEQ ID NO: 5521 - protein, 9 aa, Homo Sapiens
NCDQHVHCL

SEQ ID NO: 5522 - protein, 9 aa, Homo Sapiens
FHICGPEDV

SEQ ID NO: 5523 - protein, 9 aa, Homo Sapiens
EERFFVEGL

SEQ ID NO: 5524 - protein, 9 aa, Homo Sapiens
LISFHVTLL

SEQ ID NO: 5525 - protein, 9 aa, Homo Sapiens
PWIMTPSTL

SEQ ID NO: 5526 - protein, 9 aa, Homo Sapiens
RWIQDEMEL

SEQ ID NO: 5527 - protein, 9 aa, Homo Sapiens
VTQVVRDFL

SEQ ID NO: 5528 - protein, 9 aa, Homo Sapiens
PVELFVDWL

SEQ ID NO: 5529 - protein, 9 aa, Homo Sapiens
DGKGFRMLL

SEQ ID NO: 5530 - protein, 9 aa, Homo Sapiens
KCGHGRALL

SEQ ID NO: 5531 - protein, 9 aa, Homo Sapiens
KTISINQVL

SEQ ID NO: 5532 - protein, 9 aa, Homo Sapiens
EVLKRELGL

SEQ ID NO: 5533 - protein, 9 aa, Homo Sapiens
CDIIDIPQL

SEQ ID NO: 5534 - protein, 9 aa, Homo Sapiens
FFPDLVNML

SEQ ID NO: 5535 - protein, 9 aa, Homo Sapiens
RRWRFDATL

SEQ ID NO: 5536 - protein, 9 aa, Homo Sapiens
VMNSPSNDL

SEQ ID NO: 5537 - protein, 9 aa, Homo Sapiens
SHVQISYHS

SEQ ID NO: 5538 - protein, 9 aa, Homo Sapiens
YLTCVDISL

SEQ ID NO: 5539 - protein, 9 aa, Homo Sapiens
PSGYGGILL

SEQ ID NO: 5540 - protein, 9 aa, Homo Sapiens
VHCLQDLED

SEQ ID NO: 5541 - protein, 9 aa, Homo Sapiens
DHKLVLHTS

SEQ ID NO: 5542 - protein, 9 aa, Homo Sapiens
LHTSSYDAK

SEQ ID NO: 5543 - protein, 9 aa, Homo Sapiens
YDAKRAQVF

SEQ ID NO: 5544 - protein, 9 aa, Homo Sapiens
RHVLGQDKV

SEQ ID NO: 5545 - protein, 9 aa, Homo Sapiens
FPDAGFTGL

SEQ ID NO: 5546 - protein, 9 aa, Homo Sapiens
MTPSTLPPL

SEQ ID NO: 5547 - protein, 9 aa, Homo Sapiens
LARKAGCKL

SEQ ID NO: 5548 - protein, 9 aa, Homo Sapiens
PRDRSVSGL

SEQ ID NO: 5549 - protein, 9 aa, Homo Sapiens
SGLDSFGNL

SEQ ID NO: 5550 - protein, 9 aa, Homo Sapiens
VANGKEYPL

SEQ ID NO: 5551 - protein, 9 aa, Homo Sapiens
GRILIGGNL

SEQ ID NO: 5552 - protein, 9 aa, Homo Sapiens
ASPGACFKL

SEQ ID NO: 5553 - protein, 9 aa, Homo Sapiens
GHGRALLFQ

SEQ ID NO: 5554 - protein, 9 aa, Homo Sapiens
KATAFFPDL

SEQ ID NO: 5555 - protein, 9 aa, Homo Sapiens
NMLVLGKHL

SEQ ID NO: 5556 - protein, 9 aa, Homo Sapiens
PIINGCCCL

SEQ ID NO: 5557 - protein, 9 aa, Homo Sapiens
RSLLEPLGL

SEQ ID NO: 5558 - protein, 9 aa, Homo Sapiens
DDFTPYHML

SEQ ID NO: 5559 - protein, 9 aa, Homo Sapiens
LHGEVHCGT

SEQ ID NO: 5560 - protein, 9 aa, Homo Sapiens
GSVPEGTEM

SEQ ID NO: 5561 - protein, 9 aa, Homo Sapiens
SYHSSHEPL

SEQ ID NO: 5562 - protein, 9 aa, Homo Sapiens
VDISLDCDL

SEQ ID NO: 5563 - protein, 9 aa, Homo Sapiens
QDLEDMSVM

SEQ ID NO: 5564 - protein, 9 aa, Homo Sapiens
AALFDDHKL

SEQ ID NO: 5565 - protein, 9 aa, Homo Sapiens
FHVTLLDDS

SEQ ID NO: 5566 - protein, 9 aa, Homo Sapiens
PIFTDTVVF

SEQ ID NO: 5567 - protein, 9 aa, Homo Sapiens
RVTQVVRDF

SEQ ID NO: 5568 - protein, 9 aa, Homo Sapiens
KVQPPVELF

SEQ ID NO: 5569 - protein, 9 aa, Homo Sapiens
AVGHVDEFL

SEQ ID NO: 5570 - protein, 9 aa, Homo Sapiens
NQVLSNKDL

SEQ ID NO: 5571 - protein, 9 aa, Homo Sapiens
AFFPDLVNM

SEQ ID NO: 5572 - protein, 9 aa, Homo Sapiens
KVRSLLEPL

SEQ ID NO: 5573 - protein, 9 aa, Homo Sapiens
RADTRRWRF

SEQ ID NO: 5574 - protein, 9 aa, Homo Sapiens
RLHGDEERF

SEQ ID NO: 5575 - protein, 9 aa, Homo Sapiens
GLSFPDAGF

SEQ ID NO: 5576 - protein, 9 aa, Homo Sapiens
EVSPPVVAN

SEQ ID NO: 5577 - protein, 9 aa, Homo Sapiens
LAVGHVDEF

SEQ ID NO: 5578 - protein, 9 aa, Homo Sapiens
VPAPDGKGF

SEQ ID NO: 5579 - protein, 9 aa, Homo Sapiens
APDGKGFRM

SEQ ID NO: 5580 - protein, 9 aa, Homo Sapiens
TERKKATAF

SEQ ID NO: 5581 - protein, 9 aa, Homo Sapiens
EPLGLHCTF

SEQ ID NO: 5582 - protein, 9 aa, Homo Sapiens
IDDFTPYHM

SEQ ID NO: 5583 - protein, 9 aa, Homo Sapiens
GTNVCRKPF

SEQ ID NO: 5584 - protein, 9 aa, Homo Sapiens
SVPEGTEMF

SEQ ID NO: 5585 - protein, 9 aa, Homo Sapiens
YISPNMERG

SEQ ID NO: 5586 - protein, 9 aa, Homo Sapiens
CEGRQDRNF

SEQ ID NO: 5587 - protein, 9 aa, Homo Sapiens
RTQGPAALF

SEQ ID NO: 5588 - protein, 9 aa, Homo Sapiens
EDFSASPIF

SEQ ID NO: 5589 - protein, 9 aa, Homo Sapiens
VFRVAPWIM

SEQ ID NO: 5590 - protein, 9 aa, Homo Sapiens
YKRILGPDF

SEQ ID NO: 5591 - protein, 9 aa, Homo Sapiens
LLASPGACF

SEQ ID NO: 5592 - protein, 9 aa, Homo Sapiens
DIIDIPQLF

SEQ ID NO: 5593 - protein, 9 aa, Homo Sapiens
ERKKATAFF

SEQ ID NO: 5594 - protein, 9 aa, Homo Sapiens
VDIYISPNM

SEQ ID NO: 5595 - protein, 9 aa, Homo Sapiens
HCLQDLEDM

SEQ ID NO: 5596 - protein, 9 aa, Homo Sapiens
RFFVEGLSF

SEQ ID NO: 5597 - protein, 9 aa, Homo Sapiens
AGFTGLISF

SEQ ID NO: 5598 - protein, 9 aa, Homo Sapiens
LLDDSNEDF

SEQ ID NO: 5599 - protein, 9 aa, Homo Sapiens
EVYVCRVRN

SEQ ID NO: 5600 - protein, 9 aa, Homo Sapiens
CRVRNNTCF

SEQ ID NO: 5601 - protein, 9 aa, Homo Sapiens
NDRWIQDEM

SEQ ID NO: 5602 - protein, 9 aa, Homo Sapiens
PRNGELQDF

SEQ ID NO: 5603 - protein, 9 aa, Homo Sapiens
RSVSGLDSF

SEQ ID NO: 5604 - protein, 9 aa, Homo Sapiens
PGSSGRRVT

SEQ ID NO: 5605 - protein, 9 aa, Homo Sapiens
GSSGRRVTQ

SEQ ID NO: 5606 - protein, 9 aa, Homo Sapiens
CGHGRALLF

SEQ ID NO: 5607 - protein, 9 aa, Homo Sapiens
KDLINYNKF

SEQ ID NO: 5608 - protein, 9 aa, Homo Sapiens
NVCRKPFSF

SEQ ID NO: 5609 - protein, 9 aa, Homo Sapiens
PFSFKWWNM

SEQ ID NO: 5610 - protein, 9 aa, Homo Sapiens
MSLQRIVRV

SEQ ID NO: 5611 - protein, 9 aa, Homo Sapiens
ERADTRRWR

SEQ ID NO: 5612 - protein, 9 aa, Homo Sapiens
ILLVNCDRD

SEQ ID NO: 5613 - protein, 9 aa, Homo Sapiens
ICGPEDVCE

SEQ ID NO: 5614 - protein, 9 aa, Homo Sapiens
IFTDTVVFR

SEQ ID NO: 5615 - protein, 9 aa, Homo Sapiens
TDTVVFRVA

SEQ ID NO: 5616 - protein, 9 aa, Homo Sapiens
TREPRDRSV

SEQ ID NO: 5617 - protein, 9 aa, Homo Sapiens
NLEVSPPVV

SEQ ID NO: 5618 - protein, 9 aa, Homo Sapiens
LEVSPPVVA

SEQ ID NO: 5619 - protein, 9 aa, Homo Sapiens
GRRVTQVVR

SEQ ID NO: 5620 - protein, 9 aa, Homo Sapiens
SPGACFKLF

SEQ ID NO: 5621 - protein, 9 aa, Homo Sapiens
CCLEEKVRS

SEQ ID NO: 5622 - protein, 9 aa, Homo Sapiens
SLQRIVRVS

SEQ ID NO: 5623 - protein, 9 aa, Homo Sapiens
YGSVPEGTE

SEQ ID NO: 5624 - protein, 9 aa, Homo Sapiens
EVYGTPGVD

SEQ ID NO: 5625 - protein, 9 aa, Homo Sapiens
YGTPGVDIY

SEQ ID NO: 5626 - protein, 9 aa, Homo Sapiens
NMERGRERA

SEQ ID NO: 5627 - protein, 9 aa, Homo Sapiens
TLEIIVVMN

SEQ ID NO: 5628 - protein, 9 aa, Homo Sapiens
DMSVMVLRT

SEQ ID NO: 5629 - protein, 9 aa, Homo Sapiens
SSYDAKRAQ

SEQ ID NO: 5630 - protein, 9 aa, Homo Sapiens
GDEERFFVE

SEQ ID NO: 5631 - protein, 9 aa, Homo Sapiens
DTVVFRVAP

SEQ ID NO: 5632 - protein, 9 aa, Homo Sapiens
RVAPWIMTP

SEQ ID NO: 5633 - protein, 9 aa, Homo Sapiens
STLPPLEVY

SEQ ID NO: 5634 - protein, 9 aa, Homo Sapiens
TLPPLEVYV

SEQ ID NO: 5635 - protein, 9 aa, Homo Sapiens
PLEVYVCRV

SEQ ID NO: 5636 - protein, 9 aa, Homo Sapiens
TCFVDAVAE

SEQ ID NO: 5637 - protein, 9 aa, Homo Sapiens
ICPQAENRN

SEQ ID NO: 5638 - protein, 9 aa, Homo Sapiens
EMELGYVQA

SEQ ID NO: 5639 - protein, 9 aa, Homo Sapiens
GPDFGYVTR

SEQ ID NO: 5640 - protein, 9 aa, Homo Sapiens
VTREPRDRS

SEQ ID NO: 5641 - protein, 9 aa, Homo Sapiens
GKEYPLGRI

SEQ ID NO: 5642 - protein, 9 aa, Homo Sapiens
RRVTQVVRD

SEQ ID NO: 5643 - protein, 9 aa, Homo Sapiens
AQKVQPPVE

SEQ ID NO: 5644 - protein, 9 aa, Homo Sapiens
WLAVGHVDE

SEQ ID NO: 5645 - protein, 9 aa, Homo Sapiens
LLFQGVVDD

SEQ ID NO: 5646 - protein, 9 aa, Homo Sapiens
TISINQVLS

SEQ ID NO: 5647 - protein, 9 aa, Homo Sapiens
IPKPFGPII

SEQ ID NO: 5648 - protein, 9 aa, Homo Sapiens
LEHPTSAVC

SEQ ID NO: 5649 - protein, 9 aa, Homo Sapiens
PTSAVCVAG

SEQ ID NO: 5650 - protein, 9 aa, Homo Sapiens
TSAVCVAGV

SEQ ID NO: 5651 - protein, 9 aa, Homo Sapiens
AVCVAGVET

SEQ ID NO: 5652 - protein, 9 aa, Homo Sapiens
DIYGSVPEG

SEQ ID NO: 5653 - protein, 9 aa, Homo Sapiens
EGTEMFEVY

SEQ ID NO: 5654 - protein, 9 aa, Homo Sapiens
GTEMFEVYG

SEQ ID NO: 5655 - protein, 9 aa, Homo Sapiens
IYISPNMER

SEQ ID NO: 5656 - protein, 9 aa, Homo Sapiens
ISPNMERGR

SEQ ID NO: 5657 - protein, 9 aa, Homo Sapiens
PNMERGRER

SEQ ID NO: 5658 - protein, 9 aa, Homo Sapiens
MERGRERAD

SEQ ID NO: 5659 - protein, 9 aa, Homo Sapiens
GRERADTRR

SEQ ID NO: 5660 - protein, 9 aa, Homo Sapiens
RERADTRRW

SEQ ID NO: 5661 - protein, 9 aa, Homo Sapiens
IVVMNSPSN

SEQ ID NO: 5662 - protein, 9 aa, Homo Sapiens
EPLPLAYAV

SEQ ID NO: 5663 - protein, 9 aa, Homo Sapiens
NCEGRQDRN

SEQ ID NO: 5664 - protein, 9 aa, Homo Sapiens
GRQDRNFVD

SEQ ID NO: 5665 - protein, 9 aa, Homo Sapiens
RNFVDKRQW

SEQ ID NO: 5666 - protein, 9 aa, Homo Sapiens
GYGGILLVN

SEQ ID NO: 5667 - protein, 9 aa, Homo Sapiens
RDDPSCDVQ

SEQ ID NO: 5668 - protein, 9 aa, Homo Sapiens
DLEDMSVMV

SEQ ID NO: 5669 - protein, 9 aa, Homo Sapiens
EDMSVMVLR

SEQ ID NO: 5670 - protein, 9 aa, Homo Sapiens
TSSYDAKRA

SEQ ID NO: 5671 - protein, 9 aa, Homo Sapiens
HICGPEDVC

SEQ ID NO: 5672 - protein, 9 aa, Homo Sapiens
GPEDVCEAY

SEQ ID NO: 5673 - protein, 9 aa, Homo Sapiens
VLGQDKVSY

SEQ ID NO: 5674 - protein, 9 aa, Homo Sapiens
VSYEVPRLH

SEQ ID NO: 5675 - protein, 9 aa, Homo Sapiens
SYEVPRLHG

SEQ ID NO: 5676 - protein, 9 aa, Homo Sapiens
DEERFFVEG

SEQ ID NO: 5677 - protein, 9 aa, Homo Sapiens
FSASPIFTD

SEQ ID NO: 5678 - protein, 9 aa, Homo Sapiens
IMTPSTLPP

SEQ ID NO: 5679 - protein, 9 aa, Homo Sapiens
TPSTLPPLE

SEQ ID NO: 5680 - protein, 9 aa, Homo Sapiens
LEVYVCRVR

SEQ ID NO: 5681 - protein, 9 aa, Homo Sapiens
AVAELARKA

SEQ ID NO: 5682 - protein, 9 aa, Homo Sapiens
RKAGCKLTI

SEQ ID NO: 5683 - protein, 9 aa, Homo Sapiens
PQAENRNDR

SEQ ID NO: 5684 - protein, 9 aa, Homo Sapiens
VQAPHKTLP

SEQ ID NO: 5685 - protein, 9 aa, Homo Sapiens
APHKTLPVV

SEQ ID NO: 5686 - protein, 9 aa, Homo Sapiens
HKTLPVVFD

SEQ ID NO: 5687 - protein, 9 aa, Homo Sapiens
VVFDSPRNG

SEQ ID NO: 5688 - protein, 9 aa, Homo Sapiens
ILGPDFGYV

SEQ ID NO: 5689 - protein, 9 aa, Homo Sapiens
PDFGYVTRE

SEQ ID NO: 5690 - protein, 9 aa, Homo Sapiens
GYVTREPRD

SEQ ID NO: 5691 - protein, 9 aa, Homo Sapiens
YVTREPRDR

SEQ ID NO: 5692 - protein, 9 aa, Homo Sapiens
EPRDRSVSG

SEQ ID NO: 5693 - protein, 9 aa, Homo Sapiens
DSFGNLEVS

SEQ ID NO: 5694 - protein, 9 aa, Homo Sapiens
ILIGGNLPG

SEQ ID NO: 5695 - protein, 9 aa, Homo Sapiens
GNLPGSSGR

SEQ ID NO: 5696 - protein, 9 aa, Homo Sapiens
LPGSSGRRV

SEQ ID NO: 5697 - protein, 9 aa, Homo Sapiens
EFLSFVPAP

SEQ ID NO: 5698 - protein, 9 aa, Homo Sapiens
LASPGACFK

SEQ ID NO: 5699 - protein, 9 aa, Homo Sapiens
ALLFQGVVD

SEQ ID NO: 5700 - protein, 9 aa, Homo Sapiens
GVVDDEQVK

SEQ ID NO: 5701 - protein, 9 aa, Homo Sapiens
LINYNKFVQ

SEQ ID NO: 5702 - protein, 9 aa, Homo Sapiens
INYNKFVQS

SEQ ID NO: 5703 - protein, 9 aa, Homo Sapiens
SCIDWNREV

SEQ ID NO: 5704 - protein, 9 aa, Homo Sapiens
IDWNREVLK

SEQ ID NO: 5705 - protein, 9 aa, Homo Sapiens
IDIPQLFKT

SEQ ID NO: 5706 - protein, 9 aa, Homo Sapiens
IPQLFKTER

SEQ ID NO: 5707 - protein, 9 aa, Homo Sapiens
TAFFPDLVN

SEQ ID NO: 5708 - protein, 9 aa, Homo Sapiens
GKHLGIPKP

SEQ ID NO: 5709 - protein, 9 aa, Homo Sapiens
EVHCGTNVC

SEQ ID NO: 5710 - protein, 9 aa, Homo Sapiens
HCGTNVCRK

SEQ ID NO: 5711 - protein, 9 aa, Homo Sapiens
IVRVSLEHP

SEQ ID NO: 5712 - protein, 9 aa, Homo Sapiens
RVSLEHPTS

SEQ ID NO: 5713 - protein, 9 aa, Homo Sapiens
SLEHPTSAV

SEQ ID NO: 5714 - protein, 9 aa, Homo Sapiens
HPTSAVCVA

SEQ ID NO: 5715 - protein, 9 aa, Homo Sapiens
VAGVETLVD

SEQ ID NO: 5716 - protein, 9 aa, Homo Sapiens
AGVETLVDI

SEQ ID NO: 5717 - protein, 9 aa, Homo Sapiens
GVETLVDIY

SEQ ID NO: 5718 - protein, 9 aa, Homo Sapiens
ETLVDIYGS

SEQ ID NO: 5719 - protein, 9 aa, Homo Sapiens
VDIYGSVPE

SEQ ID NO: 5720 - protein, 9 aa, Homo Sapiens
IYGSVPEGT

SEQ ID NO: 5721 - protein, 9 aa, Homo Sapiens
EMFEVYGTP

SEQ ID NO: 5722 - protein, 9 aa, Homo Sapiens
VYGTPGVDI

SEQ ID NO: 5723 - protein, 9 aa, Homo Sapiens
TPGVDIYIS

SEQ ID NO: 5724 - protein, 9 aa, Homo Sapiens
SPNMERGRE

SEQ ID NO: 5725 - protein, 9 aa, Homo Sapiens
DATLEIIVV

SEQ ID NO: 5726 - protein, 9 aa, Homo Sapiens
EIIVVMNSP

SEQ ID NO: 5727 - protein, 9 aa, Homo Sapiens
IIVVMNSPS

SEQ ID NO: 5728 - protein, 9 aa, Homo Sapiens
MNSPSNDLN

SEQ ID NO: 5729 - protein, 9 aa, Homo Sapiens
DLNDSHVQI

SEQ ID NO: 5730 - protein, 9 aa, Homo Sapiens
ISYHSSHEP

SEQ ID NO: 5731 - protein, 9 aa, Homo Sapiens
SSHEPLPLA

SEQ ID NO: 5732 - protein, 9 aa, Homo Sapiens
AYAVLYLTC

SEQ ID NO: 5733 - protein, 9 aa, Homo Sapiens
ISLDCDLNC

SEQ ID NO: 5734 - protein, 9 aa, Homo Sapiens
LNCEGRQDR

SEQ ID NO: 5735 - protein, 9 aa, Homo Sapiens
EGRQDRNFV

SEQ ID NO: 5736 - protein, 9 aa, Homo Sapiens
RQDRNFVDK

SEQ ID NO: 5737 - protein, 9 aa, Homo Sapiens
FVDKRQWVW

SEQ ID NO: 5738 - protein, 9 aa, Homo Sapiens
SGYGGILLV

SEQ ID NO: 5739 - protein, 9 aa, Homo Sapiens
YGGILLVNC

SEQ ID NO: 5740 - protein, 9 aa, Homo Sapiens
DNCDQHVHC

SEQ ID NO: 5741 - protein, 9 aa, Homo Sapiens
MSVMVLRTQ

SEQ ID NO: 5742 - protein, 9 aa, Homo Sapiens
TQGPAALFD

SEQ ID NO: 5743 - protein, 9 aa, Homo Sapiens
CGPEDVCEA

SEQ ID NO: 5744 - protein, 9 aa, Homo Sapiens
EDVCEAYRH

SEQ ID NO: 5745 - protein, 9 aa, Homo Sapiens
DVCEAYRHV

SEQ ID NO: 5746 - protein, 9 aa, Homo Sapiens
CEAYRHVLG

SEQ ID NO: 5747 - protein, 9 aa, Homo Sapiens
HVLGQDKVS

SEQ ID NO: 5748 - protein, 9 aa, Homo Sapiens
GQDKVSYEV

SEQ ID NO: 5749 - protein, 9 aa, Homo Sapiens
QDKVSYEVP

SEQ ID NO: 5750 - protein, 9 aa, Homo Sapiens
YEVPRLHGD

SEQ ID NO: 5751 - protein, 9 aa, Homo Sapiens
EGLSFPDAG

SEQ ID NO: 5752 - protein, 9 aa, Homo Sapiens
GFTGLISFH

SEQ ID NO: 5753 - protein, 9 aa, Homo Sapiens
TGLISFHVT

SEQ ID NO: 5754 - protein, 9 aa, Homo Sapiens
TLLDDSNED

SEQ ID NO: 5755 - protein, 9 aa, Homo Sapiens
SASPIFTDT

SEQ ID NO: 5756 - protein, 9 aa, Homo Sapiens
FTDTVVFRV

SEQ ID NO: 5757 - protein, 9 aa, Homo Sapiens
PSTLPPLEV

SEQ ID NO: 5758 - protein, 9 aa, Homo Sapiens
LPPLEVYVC

SEQ ID NO: 5759 - protein, 9 aa, Homo Sapiens
PPLEVYVCR

SEQ ID NO: 5760 - protein, 9 aa, Homo Sapiens
VYVCRVRNN

SEQ ID NO: 5761 - protein, 9 aa, Homo Sapiens
VDAVAELAR

SEQ ID NO: 5762 - protein, 9 aa, Homo Sapiens
VAELARKAG

SEQ ID NO: 5763 - protein, 9 aa, Homo Sapiens
TICPQAENR

SEQ ID NO: 5764 - protein, 9 aa, Homo Sapiens
QAENRNDRW

SEQ ID NO: 5765 - protein, 9 aa, Homo Sapiens
AENRNDRWI

SEQ ID NO: 5766 - protein, 9 aa, Homo Sapiens
IQDEMELGY

SEQ ID NO: 5767 - protein, 9 aa, Homo Sapiens
DEMELGYVQ

SEQ ID NO: 5768 - protein, 9 aa, Homo Sapiens
MELGYVQAP

SEQ ID NO: 5769 - protein, 9 aa, Homo Sapiens
GYVQAPHKT

SEQ ID NO: 5770 - protein, 9 aa, Homo Sapiens
KTLPVVFDS

SEQ ID NO: 5771 - protein, 9 aa, Homo Sapiens
PVVFDSPRN

SEQ ID NO: 5772 - protein, 9 aa, Homo Sapiens
GELQDFPYK

SEQ ID NO: 5773 - protein, 9 aa, Homo Sapiens
ELQDFPYKR

SEQ ID NO: 5774 - protein, 9 aa, Homo Sapiens
LQDFPYKRI

SEQ ID NO: 5775 - protein, 9 aa, Homo Sapiens
LGPDFGYVT

SEQ ID NO: 5776 - protein, 9 aa, Homo Sapiens
DFGYVTREP

SEQ ID NO: 5777 - protein, 9 aa, Homo Sapiens
REPRDRSVS

SEQ ID NO: 5778 - protein, 9 aa, Homo Sapiens
LDSFGNLEV

SEQ ID NO: 5779 - protein, 9 aa, Homo Sapiens
GNLEVSPPV

SEQ ID NO: 5780 - protein, 9 aa, Homo Sapiens
VSPPVVANG

SEQ ID NO: 5781 - protein, 9 aa, Homo Sapiens
VVANGKEYP

SEQ ID NO: 5782 - protein, 9 aa, Homo Sapiens
EYPLGRILI

SEQ ID NO: 5783 - protein, 9 aa, Homo Sapiens
YPLGRILIG

SEQ ID NO: 5784 - protein, 9 aa, Homo Sapiens
LIGGNLPGS

SEQ ID NO: 5785 - protein, 9 aa, Homo Sapiens
IGGNLPGSS

SEQ ID NO: 5786 - protein, 9 aa, Homo Sapiens
NLPGSSGRR

SEQ ID NO: 5787 - protein, 9 aa, Homo Sapiens
FLHAQKVQP

SEQ ID NO: 5788 - protein, 9 aa, Homo Sapiens
QPPVELFVD

SEQ ID NO: 5789 - protein, 9 aa, Homo Sapiens
PPVELFVDW

SEQ ID NO: 5790 - protein, 9 aa, Homo Sapiens
ELFVDWLAV

SEQ ID NO: 5791 - protein, 9 aa, Homo Sapiens
LFVDWLAVG

SEQ ID NO: 5792 - protein, 9 aa, Homo Sapiens
VDEFLSFVP

SEQ ID NO: 5793 - protein, 9 aa, Homo Sapiens
LSFVPAPDG

SEQ ID NO: 5794 - protein, 9 aa, Homo Sapiens
SFVPAPDGK

SEQ ID NO: 5795 - protein, 9 aa, Homo Sapiens
PAPDGKGFR

SEQ ID NO: 5796 - protein, 9 aa, Homo Sapiens
FQEKQKCGH

SEQ ID NO: 5797 - protein, 9 aa, Homo Sapiens
KQKCGHGRA

SEQ ID NO: 5798 - protein, 9 aa, Homo Sapiens
VVDDEQVKT

SEQ ID NO: 5799 - protein, 9 aa, Homo Sapiens
VDDEQVKTI

SEQ ID NO: 5800 - protein, 9 aa, Homo Sapiens
DDEQVKTIS

SEQ ID NO: 5801 - protein, 9 aa, Homo Sapiens
EQVKTISIN

SEQ ID NO: 5802 - protein, 9 aa, Homo Sapiens
ISINQVLSN

SEQ ID NO: 5803 - protein, 9 aa, Homo Sapiens
INQVLSNKD

SEQ ID NO: 5804 - protein, 9 aa, Homo Sapiens
WNREVLKRE

SEQ ID NO: 5805 - protein, 9 aa, Homo Sapiens
KRELGLAEC

SEQ ID NO: 5806 - protein, 9 aa, Homo Sapiens
GLAECDIID

SEQ ID NO: 5807 - protein, 9 aa, Homo Sapiens
IIDIPQLFK

SEQ ID NO: 5808 - protein, 9 aa, Homo Sapiens
QLFKTERKK

SEQ ID NO: 5809 - protein, 9 aa, Homo Sapiens
FKTERKKAT

SEQ ID NO: 5810 - protein, 9 aa, Homo Sapiens
KTERKKATA

SEQ ID NO: 5811 - protein, 9 aa, Homo Sapiens
HLGIPKPFG

SEQ ID NO: 5812 - protein, 9 aa, Homo Sapiens
LGIPKPFGP

SEQ ID NO: 5813 - protein, 9 aa, Homo Sapiens
GIPKPFGPI

SEQ ID NO: 5814 - protein, 9 aa, Homo Sapiens
KPFGPIING

SEQ ID NO: 5815 - protein, 9 aa, Homo Sapiens
PFGPIINGC

SEQ ID NO: 5816 - protein, 9 aa, Homo Sapiens
IINGCCCLE

SEQ ID NO: 5817 - protein, 9 aa, Homo Sapiens
INGCCCLEE

SEQ ID NO: 5818 - protein, 9 aa, Homo Sapiens
LLEPLGLHC

SEQ ID NO: 5819 - protein, 9 aa, Homo Sapiens
HMLHGEVHC

SEQ ID NO: 5820 - protein, 9 aa, Homo Sapiens
HGEVHCGTN

SEQ ID NO: 5821 - protein, 9 aa, Homo Sapiens
TNVCRKPFS

SEQ ID NO: 5822 - protein, 9 aa, Homo Sapiens
QRIVRVSLE

SEQ ID NO: 5823 - protein, 9 aa, Homo Sapiens
VSLEHPTSA

SEQ ID NO: 5824 - protein, 9 aa, Homo Sapiens
SAVCVAGVE

SEQ ID NO: 5825 - protein, 9 aa, Homo Sapiens
CVAGVETLV

SEQ ID NO: 5826 - protein, 9 aa, Homo Sapiens
TLVDIYGSV

SEQ ID NO: 5827 - protein, 9 aa, Homo Sapiens
LVDIYGSVP

SEQ ID NO: 5828 - protein, 9 aa, Homo Sapiens
VPEGTEMFE

SEQ ID NO: 5829 - protein, 9 aa, Homo Sapiens
PEGTEMFEV

SEQ ID NO: 5830 - protein, 9 aa, Homo Sapiens
TEMFEVYGT

SEQ ID NO: 5831 - protein, 9 aa, Homo Sapiens
MFEVYGTPG

SEQ ID NO: 5832 - protein, 9 aa, Homo Sapiens
FEVYGTPGV

SEQ ID NO: 5833 - protein, 9 aa, Homo Sapiens
GTPGVDIYI

SEQ ID NO: 5834 - protein, 9 aa, Homo Sapiens
GVDIYISPN

SEQ ID NO: 5835 - protein, 9 aa, Homo Sapiens
ERGRERADT

SEQ ID NO: 5836 - protein, 9 aa, Homo Sapiens
RGRERADTR

SEQ ID NO: 5837 - protein, 9 aa, Homo Sapiens
ADTRRWRFD

SEQ ID NO: 5838 - protein, 9 aa, Homo Sapiens
TRRWRFDAT

SEQ ID NO: 5839 - protein, 9 aa, Homo Sapiens
WRFDATLEI

SEQ ID NO: 5840 - protein, 9 aa, Homo Sapiens
NDLNDSHVQ

SEQ ID NO: 5841 - protein, 9 aa, Homo Sapiens
DSHVQISYH

SEQ ID NO: 5842 - protein, 9 aa, Homo Sapiens
LPLAYAVLY

SEQ ID NO: 5843 - protein, 9 aa, Homo Sapiens
AVLYLTCVD

SEQ ID NO: 5844 - protein, 9 aa, Homo Sapiens
VLYLTCVDI

SEQ ID NO: 5845 - protein, 9 aa, Homo Sapiens
LTCVDISLD

SEQ ID NO: 5846 - protein, 9 aa, Homo Sapiens
TCVDISLDC

SEQ ID NO: 5847 - protein, 9 aa, Homo Sapiens
LDCDLNCEG

SEQ ID NO: 5848 - protein, 9 aa, Homo Sapiens
CDLNCEGRQ

SEQ ID NO: 5849 - protein, 9 aa, Homo Sapiens
DLNCEGRQD

SEQ ID NO: 5850 - protein, 9 aa, Homo Sapiens
DRNFVDKRQ

SEQ ID NO: 5851 - protein, 9 aa, Homo Sapiens
NFVDKRQWV

SEQ ID NO: 5852 - protein, 9 aa, Homo Sapiens
VDKRQWVWG

SEQ ID NO: 5853 - protein, 9 aa, Homo Sapiens
DKRQWVWGP

SEQ ID NO: 5854 - protein, 9 aa, Homo Sapiens
RQWVWGPSG

SEQ ID NO: 5855 - protein, 9 aa, Homo Sapiens
QWVWGPSGY

SEQ ID NO: 5856 - protein, 9 aa, Homo Sapiens
WVWGPSGYG

SEQ ID NO: 5857 - protein, 9 aa, Homo Sapiens
VWGPSGYGG

SEQ ID NO: 5858 - protein, 9 aa, Homo Sapiens
GGILLVNCD

SEQ ID NO: 5859 - protein, 9 aa, Homo Sapiens
LLVNCDRDD

SEQ ID NO: 5860 - protein, 9 aa, Homo Sapiens
CDRDDPSCD

SEQ ID NO: 5861 - protein, 9 aa, Homo Sapiens
DRDDPSCDV

SEQ ID NO: 5862 - protein, 9 aa, Homo Sapiens
DDPSCDVQD

SEQ ID NO: 5863 - protein, 9 aa, Homo Sapiens
DPSCDVQDN

SEQ ID NO: 5864 - protein, 9 aa, Homo Sapiens
DVQDNCDQH

SEQ ID NO: 5865 - protein, 9 aa, Homo Sapiens
QDNCDQHVH

SEQ ID NO: 5866 - protein, 9 aa, Homo Sapiens
SVMVLRTQG

SEQ ID NO: 5867 - protein, 9 aa, Homo Sapiens
VLRTQGPAA

SEQ ID NO: 5868 - protein, 9 aa, Homo Sapiens
GPAALFDDH

SEQ ID NO: 5869 - protein, 9 aa, Homo Sapiens
FDDHKLVLH

SEQ ID NO: 5870 - protein, 9 aa, Homo Sapiens
DDHKLVLHT

SEQ ID NO: 5871 - protein, 9 aa, Homo Sapiens
DAKRAQVFH

SEQ ID NO: 5872 - protein, 9 aa, Homo Sapiens
KRAQVFHIC

SEQ ID NO: 5873 - protein, 9 aa, Homo Sapiens
VFHICGPED

SEQ ID NO: 5874 - protein, 9 aa, Homo Sapiens
EAYRHVLGQ

SEQ ID NO: 5875 - protein, 9 aa, Homo Sapiens
YRHVLGQDK

SEQ ID NO: 5876 - protein, 9 aa, Homo Sapiens
LGQDKVSYE

SEQ ID NO: 5877 - protein, 9 aa, Homo Sapiens
DKVSYEVPR

SEQ ID NO: 5878 - protein, 9 aa, Homo Sapiens
PRLHGDEER

SEQ ID NO: 5879 - protein, 9 aa, Homo Sapiens
HGDEERFFV

SEQ ID NO: 5880 - protein, 9 aa, Homo Sapiens
FFVEGLSFP

SEQ ID NO: 5881 - protein, 9 aa, Homo Sapiens
FVEGLSFPD

SEQ ID NO: 5882 - protein, 9 aa, Homo Sapiens
LSFPDAGFT

SEQ ID NO: 5883 - protein, 9 aa, Homo Sapiens
SFPDAGFTG

SEQ ID NO: 5884 - protein, 9 aa, Homo Sapiens
PDAGFTGLI

SEQ ID NO: 5885 - protein, 9 aa, Homo Sapiens
ISFHVTLLD

SEQ ID NO: 5886 - protein, 9 aa, Homo Sapiens
DSNEDFSAS

SEQ ID NO: 5887 - protein, 9 aa, Homo Sapiens
SNEDFSASP

SEQ ID NO: 5888 - protein, 9 aa, Homo Sapiens
DFSASPIFT

SEQ ID NO: 5889 - protein, 9 aa, Homo Sapiens
SPIFTDTVV

SEQ ID NO: 5890 - protein, 9 aa, Homo Sapiens
TVVFRVAPW

SEQ ID NO: 5891 - protein, 9 aa, Homo Sapiens
YVCRVRNNT

SEQ ID NO: 5892 - protein, 9 aa, Homo Sapiens
VCRVRNNTC

SEQ ID NO: 5893 - protein, 9 aa, Homo Sapiens
VRNNTCFVD

SEQ ID NO: 5894 - protein, 9 aa, Homo Sapiens
RNNTCFVDA

SEQ ID NO: 5895 - protein, 9 aa, Homo Sapiens
NNTCFVDAV

SEQ ID NO: 5896 - protein, 9 aa, Homo Sapiens
NTCFVDAVA

SEQ ID NO: 5897 - protein, 9 aa, Homo Sapiens
DAVAELARK

SEQ ID NO: 5898 - protein, 9 aa, Homo Sapiens
ELARKAGCK

SEQ ID NO: 5899 - protein, 9 aa, Homo Sapiens
GCKLTICPQ

SEQ ID NO: 5900 - protein, 9 aa, Homo Sapiens
KLTICPQAE

SEQ ID NO: 5901 - protein, 9 aa, Homo Sapiens
LTICPQAEN

SEQ ID NO: 5902 - protein, 9 aa, Homo Sapiens
CPQAENRND

SEQ ID NO: 5903 - protein, 9 aa, Homo Sapiens
ENRNDRWIQ

SEQ ID NO: 5904 - protein, 9 aa, Homo Sapiens
WIQDEMELG

SEQ ID NO: 5905 - protein, 9 aa, Homo Sapiens
LGYVQAPHK

SEQ ID NO: 5906 - protein, 9 aa, Homo Sapiens
TLPVVFDSP

SEQ ID NO: 5907 - protein, 9 aa, Homo Sapiens
VFDSPRNGE

SEQ ID NO: 5908 - protein, 9 aa, Homo Sapiens
FPYKRILGP

SEQ ID NO: 5909 - protein, 9 aa, Homo Sapiens
KRILGPDFG

SEQ ID NO: 5910 - protein, 9 aa, Homo Sapiens
RILGPDFGY

SEQ ID NO: 5911 - protein, 9 aa, Homo Sapiens
FGYVTREPR

SEQ ID NO: 5912 - protein, 9 aa, Homo Sapiens
DRSVSGLDS

SEQ ID NO: 5913 - protein, 9 aa, Homo Sapiens
SVSGLDSFG

SEQ ID NO: 5914 - protein, 9 aa, Homo Sapiens
SFGNLEVSP

SEQ ID NO: 5915 - protein, 9 aa, Homo Sapiens
PVVANGKEY

SEQ ID NO: 5916 - protein, 9 aa, Homo Sapiens
ANGKEYPLG

SEQ ID NO: 5917 - protein, 9 aa, Homo Sapiens
NGKEYPLGR

SEQ ID NO: 5918 - protein, 9 aa, Homo Sapiens
GGNLPGSSG

SEQ ID NO: 5919 - protein, 9 aa, Homo Sapiens
SGRRVTQVV

SEQ ID NO: 5920 - protein, 9 aa, Homo Sapiens
TQVVRDFLH

SEQ ID NO: 5921 - protein, 9 aa, Homo Sapiens
VVRDFLHAQ

SEQ ID NO: 5922 - protein, 9 aa, Homo Sapiens
DFLHAQKVQ

SEQ ID NO: 5923 - protein, 9 aa, Homo Sapiens
HAQKVQPPV

SEQ ID NO: 5924 - protein, 9 aa, Homo Sapiens
VQPPVELFV

SEQ ID NO: 5925 - protein, 9 aa, Homo Sapiens
FVDWLAVGH

SEQ ID NO: 5926 - protein, 9 aa, Homo Sapiens
DWLAVGHVD

SEQ ID NO: 5927 - protein, 9 aa, Homo Sapiens
DEFLSFVPA

SEQ ID NO: 5928 - protein, 9 aa, Homo Sapiens
FLSFVPAPD

SEQ ID NO: 5929 - protein, 9 aa, Homo Sapiens
GKGFRMLLA

SEQ ID NO: 5930 - protein, 9 aa, Homo Sapiens
MLLASPGAC

SEQ ID NO: 5931 - protein, 9 aa, Homo Sapiens
PGACFKLFQ

SEQ ID NO: 5932 - protein, 9 aa, Homo Sapiens
ACFKLFQEK

SEQ ID NO: 5933 - protein, 9 aa, Homo Sapiens
KLFQEKQKC

SEQ ID NO: 5934 - protein, 9 aa, Homo Sapiens
EKQKCGHGR

SEQ ID NO: 5935 - protein, 9 aa, Homo Sapiens
GRALLFQGV

SEQ ID NO: 5936 - protein, 9 aa, Homo Sapiens
RALLFQGVV

SEQ ID NO: 5937 - protein, 9 aa, Homo Sapiens
LFQGVVDDE

SEQ ID NO: 5938 - protein, 9 aa, Homo Sapiens
FQGVVDDEQ

SEQ ID NO: 5939 - protein, 9 aa, Homo Sapiens
QVLSNKDLI

SEQ ID NO: 5940 - protein, 9 aa, Homo Sapiens
SNKDLINYN

SEQ ID NO: 5941 - protein, 9 aa, Homo Sapiens
NYNKFVQSC

SEQ ID NO: 5942 - protein, 9 aa, Homo Sapiens
QSCIDWNRE

SEQ ID NO: 5943 - protein, 9 aa, Homo Sapiens
LKRELGLAE

SEQ ID NO: 5944 - protein, 9 aa, Homo Sapiens
LAECDIIDI

SEQ ID NO: 5945 - protein, 9 aa, Homo Sapiens
AECDIIDIP

SEQ ID NO: 5946 - protein, 9 aa, Homo Sapiens
DIPQLFKTE

SEQ ID NO: 5947 - protein, 9 aa, Homo Sapiens
PQLFKTERK

SEQ ID NO: 5948 - protein, 9 aa, Homo Sapiens
ATAFFPDLV

SEQ ID NO: 5949 - protein, 9 aa, Homo Sapiens
DLVNMLVLG

SEQ ID NO: 5950 - protein, 9 aa, Homo Sapiens
MLVLGKHLG

SEQ ID NO: 5951 - protein, 9 aa, Homo Sapiens
PKPFGPIIN

SEQ ID NO: 5952 - protein, 9 aa, Homo Sapiens
GPIINGCCC

SEQ ID NO: 5953 - protein, 9 aa, Homo Sapiens
CCCLEEKVR

SEQ ID NO: 5954 - protein, 9 aa, Homo Sapiens
EEKVRSLLE

SEQ ID NO: 5955 - protein, 9 aa, Homo Sapiens
EKVRSLLEP

SEQ ID NO: 5956 - protein, 9 aa, Homo Sapiens
VRSLLEPLG

SEQ ID NO: 5957 - protein, 9 aa, Homo Sapiens
SLLEPLGLH

SEQ ID NO: 5958 - protein, 9 aa, Homo Sapiens
TFIDDFTPY

SEQ ID NO: 5959 - protein, 9 aa, Homo Sapiens
FIDDFTPYH

SEQ ID NO: 5960 - protein, 9 aa, Homo Sapiens
DFTPYHMLH

SEQ ID NO: 5961 - protein, 9 aa, Homo Sapiens
MLHGEVHCG

SEQ ID NO: 5962 - protein, 9 aa, Homo Sapiens
CGTNVCRKP

SEQ ID NO: 5963 - protein, 9 aa, Homo Sapiens
VCRKPFSFK

SEQ ID NO: 5964 - protein, 9 aa, Homo Sapiens
CRKPFSFKW

SEQ ID NO: 5965 - protein, 9 aa, Homo Sapiens
SFKWWNMVP

SEQ ID NO: 5966 - protein, 9 aa, Homo Sapiens
RIVRVSLEH

SEQ ID NO: 5967 - protein, 9 aa, Homo Sapiens
PGVDIYISP

SEQ ID NO: 5968 - protein, 9 aa, Homo Sapiens
DIYISPNME

SEQ ID NO: 5969 - protein, 9 aa, Homo Sapiens
DTRRWRFDA

SEQ ID NO: 5970 - protein, 9 aa, Homo Sapiens
FDATLEIIV

SEQ ID NO: 5971 - protein, 9 aa, Homo Sapiens
LEIIVVMNS

SEQ ID NO: 5972 - protein, 9 aa, Homo Sapiens
VVMNSPSND

SEQ ID NO: 5973 - protein, 9 aa, Homo Sapiens
NSPSNDLND

SEQ ID NO: 5974 - protein, 9 aa, Homo Sapiens
SPSNDLNDS

SEQ ID NO: 5975 - protein, 9 aa, Homo Sapiens
PSNDLNDSH

SEQ ID NO: 5976 - protein, 9 aa, Homo Sapiens
SNDLNDSHV

SEQ ID NO: 5977 - protein, 9 aa, Homo Sapiens
LNDSHVQIS

SEQ ID NO: 5978 - protein, 9 aa, Homo Sapiens
NDSHVQISY

SEQ ID NO: 5979 - protein, 9 aa, Homo Sapiens
QISYHSSHE

SEQ ID NO: 5980 - protein, 9 aa, Homo Sapiens
HEPLPLAYA

SEQ ID NO: 5981 - protein, 9 aa, Homo Sapiens
YAVLYLTCV

SEQ ID NO: 5982 - protein, 9 aa, Homo Sapiens
LYLTCVDIS

SEQ ID NO: 5983 - protein, 9 aa, Homo Sapiens
DISLDCDLN

SEQ ID NO: 5984 - protein, 9 aa, Homo Sapiens
DCDLNCEGR

SEQ ID NO: 5985 - protein, 9 aa, Homo Sapiens
QDRNFVDKR

SEQ ID NO: 5986 - protein, 9 aa, Homo Sapiens
WGPSGYGGI

SEQ ID NO: 5987 - protein, 9 aa, Homo Sapiens
GILLVNCDR

SEQ ID NO: 5988 - protein, 9 aa, Homo Sapiens
LVNCDRDDP

SEQ ID NO: 5989 - protein, 9 aa, Homo Sapiens
VNCDRDDPS

SEQ ID NO: 5990 - protein, 9 aa, Homo Sapiens
NCDRDDPSC

SEQ ID NO: 5991 - protein, 9 aa, Homo Sapiens
PSCDVQDNC

SEQ ID NO: 5992 - protein, 9 aa, Homo Sapiens
SCDVQDNCD

SEQ ID NO: 5993 - protein, 9 aa, Homo Sapiens
CDVQDNCDQ

SEQ ID NO: 5994 - protein, 9 aa, Homo Sapiens
DQHVHCLQD

SEQ ID NO: 5995 - protein, 9 aa, Homo Sapiens
CLQDLEDMS

SEQ ID NO: 5996 - protein, 9 aa, Homo Sapiens
PAALFDDHK

SEQ ID NO: 5997 - protein, 9 aa, Homo Sapiens
ALFDDHKLV

SEQ ID NO: 5998 - protein, 9 aa, Homo Sapiens
HKLVLHTSS

SEQ ID NO: 5999 - protein, 9 aa, Homo Sapiens
HTSSYDAKR

SEQ ID NO: 6000 - protein, 9 aa, Homo Sapiens
SYDAKRAQV

SEQ ID NO: 6001 - protein, 9 aa, Homo Sapiens
AKRAQVFHI

SEQ ID NO: 6002 - protein, 9 aa, Homo Sapiens
RAQVFHICG

SEQ ID NO: 6003 - protein, 9 aa, Homo Sapiens
AQVFHICGP

SEQ ID NO: 6004 - protein, 9 aa, Homo Sapiens
PEDVCEAYR

SEQ ID NO: 6005 - protein, 9 aa, Homo Sapiens
EVPRLHGDE

SEQ ID NO: 6006 - protein, 9 aa, Homo Sapiens
VPRLHGDEE

SEQ ID NO: 6007 - protein, 9 aa, Homo Sapiens
ERFFVEGLS

SEQ ID NO: 6008 - protein, 9 aa, Homo Sapiens
VEGLSFPDA

SEQ ID NO: 6009 - protein, 9 aa, Homo Sapiens
SFHVTLLDD

SEQ ID NO: 6010 - protein, 9 aa, Homo Sapiens
LDDSNEDFS

SEQ ID NO: 6011 - protein, 9 aa, Homo Sapiens
DDSNEDFSA

SEQ ID NO: 6012 - protein, 9 aa, Homo Sapiens
ASPIFTDTV

SEQ ID NO: 6013 - protein, 9 aa, Homo Sapiens
VVFRVAPWI

SEQ ID NO: 6014 - protein, 9 aa, Homo Sapiens
FRVAPWIMT

SEQ ID NO: 6015 - protein, 9 aa, Homo Sapiens
VAPWIMTPS

SEQ ID NO: 6016 - protein, 9 aa, Homo Sapiens
APWIMTPST

SEQ ID NO: 6017 - protein, 9 aa, Homo Sapiens
WIMTPSTLP

SEQ ID NO: 6018 - protein, 9 aa, Homo Sapiens
RVRNNTCFV

SEQ ID NO: 6019 - protein, 9 aa, Homo Sapiens
AELARKAGC

SEQ ID NO: 6020 - protein, 9 aa, Homo Sapiens
ARKAGCKLT

SEQ ID NO: 6021 - protein, 9 aa, Homo Sapiens
AGCKLTICP

SEQ ID NO: 6022 - protein, 9 aa, Homo Sapiens
CKLTICPQA

SEQ ID NO: 6023 - protein, 9 aa, Homo Sapiens
NRNDRWIQD

SEQ ID NO: 6024 - protein, 9 aa, Homo Sapiens
RNDRWIQDE

SEQ ID NO: 6025 - protein, 9 aa, Homo Sapiens
QDEMELGYV

SEQ ID NO: 6026 - protein, 9 aa, Homo Sapiens
ELGYVQAPH

SEQ ID NO: 6027 - protein, 9 aa, Homo Sapiens
LPVVFDSPR

SEQ ID NO: 6028 - protein, 9 aa, Homo Sapiens
DSPRNGELQ

SEQ ID NO: 6029 - protein, 9 aa, Homo Sapiens
SPRNGELQD

SEQ ID NO: 6030 - protein, 9 aa, Homo Sapiens
RNGELQDFP

SEQ ID NO: 6031 - protein, 9 aa, Homo Sapiens
NGELQDFPY

SEQ ID NO: 6032 - protein, 9 aa, Homo Sapiens
DFPYKRILG

SEQ ID NO: 6033 - protein, 9 aa, Homo Sapiens
GLDSFGNLE

SEQ ID NO: 6034 - protein, 9 aa, Homo Sapiens
FGNLEVSPP

SEQ ID NO: 6035 - protein, 9 aa, Homo Sapiens
SPPVVANGK

SEQ ID NO: 6036 - protein, 9 aa, Homo Sapiens
PPVVANGKE

SEQ ID NO: 6037 - protein, 9 aa, Homo Sapiens
LGRILIGGN

SEQ ID NO: 6038 - protein, 9 aa, Homo Sapiens
RILIGGNLP

SEQ ID NO: 6039 - protein, 9 aa, Homo Sapiens
SSGRRVTQV

SEQ ID NO: 6040 - protein, 9 aa, Homo Sapiens
VDWLAVGHV

SEQ ID NO: 6041 - protein, 9 aa, Homo Sapiens
VGHVDEFLS

SEQ ID NO: 6042 - protein, 9 aa, Homo Sapiens
HVDEFLSFV

SEQ ID NO: 6043 - protein, 9 aa, Homo Sapiens
FVPAPDGKG

SEQ ID NO: 6044 - protein, 9 aa, Homo Sapiens
KGFRMLLAS

SEQ ID NO: 6045 - protein, 9 aa, Homo Sapiens
GFRMLLASP

SEQ ID NO: 6046 - protein, 9 aa, Homo Sapiens
RMLLASPGA

SEQ ID NO: 6047 - protein, 9 aa, Homo Sapiens
GACFKLFQE

SEQ ID NO: 6048 - protein, 9 aa, Homo Sapiens
LFQEKQKCG

SEQ ID NO: 6049 - protein, 9 aa, Homo Sapiens
QEKQKCGHG

SEQ ID NO: 6050 - protein, 9 aa, Homo Sapiens
QGVVDDEQV

SEQ ID NO: 6051 - protein, 9 aa, Homo Sapiens
DEQVKTISI

SEQ ID NO: 6052 - protein, 9 aa, Homo Sapiens
VKTISINQV

SEQ ID NO: 6053 - protein, 9 aa, Homo Sapiens
SINQVLSNK

SEQ ID NO: 6054 - protein, 9 aa, Homo Sapiens
VLSNKDLIN

SEQ ID NO: 6055 - protein, 9 aa, Homo Sapiens
LSNKDLINY

SEQ ID NO: 6056 - protein, 9 aa, Homo Sapiens
YNKFVQSCI

SEQ ID NO: 6057 - protein, 9 aa, Homo Sapiens
NKFVQSCID

SEQ ID NO: 6058 - protein, 9 aa, Homo Sapiens
KFVQSCIDW

SEQ ID NO: 6059 - protein, 9 aa, Homo Sapiens
FVQSCIDWN

SEQ ID NO: 6060 - protein, 9 aa, Homo Sapiens
VQSCIDWNR

SEQ ID NO: 6061 - protein, 9 aa, Homo Sapiens
DWNREVLKR

SEQ ID NO: 6062 - protein, 9 aa, Homo Sapiens
REVLKRELG

SEQ ID NO: 6063 - protein, 9 aa, Homo Sapiens
RELGLAECD

SEQ ID NO: 6064 - protein, 9 aa, Homo Sapiens
ELGLAECDI

SEQ ID NO: 6065 - protein, 9 aa, Homo Sapiens
ECDIIDIPQ

SEQ ID NO: 6066 - protein, 9 aa, Homo Sapiens
LFKTERKKA

SEQ ID NO: 6067 - protein, 9 aa, Homo Sapiens
KKATAFFPD

SEQ ID NO: 6068 - protein, 9 aa, Homo Sapiens
LVNMLVLGK

SEQ ID NO: 6069 - protein, 9 aa, Homo Sapiens
LVLGKHLGI

SEQ ID NO: 6070 - protein, 9 aa, Homo Sapiens
VLGKHLGIP

SEQ ID NO: 6071 - protein, 9 aa, Homo Sapiens
NGCCCLEEK

SEQ ID NO: 6072 - protein, 9 aa, Homo Sapiens
GCCCLEEKV

SEQ ID NO: 6073 - protein, 9 aa, Homo Sapiens
LEPLGLHCT

SEQ ID NO: 6074 - protein, 9 aa, Homo Sapiens
GLHCTFIDD

SEQ ID NO: 6075 - protein, 9 aa, Homo Sapiens
CTFIDDFTP

SEQ ID NO: 6076 - protein, 9 aa, Homo Sapiens
FTPYHMLHG

SEQ ID NO: 6077 - protein, 9 aa, Homo Sapiens
TPYHMLHGE

SEQ ID NO: 6078 - protein, 9 aa, Homo Sapiens
PYHMLHGEV

SEQ ID NO: 6079 - protein, 9 aa, Homo Sapiens
GEVHCGTNV

SEQ ID NO: 6080 - protein, 9 aa, Homo Sapiens
KPFSFKWWN

SEQ ID NO: 6081 - protein, 9 aa, Homo Sapiens
FSFKWWNMV

SEQ ID NO: 6082 - protein, 9 aa, Homo Sapiens
MTPSTLAPL

SEQ ID NO: 6083 - protein, 9 aa, Homo Sapiens
TLAPLEVYV

SEQ ID NO: 6084 - protein, 9 aa, Homo Sapiens
IMTPSTLAP

SEQ ID NO: 6085 - protein, 9 aa, Homo Sapiens
TPSTLAPLE

SEQ ID NO: 6086 - protein, 9 aa, Homo Sapiens
STLAPLEVY

SEQ ID NO: 6087 - protein, 9 aa, Homo Sapiens
LAPLEVYVC

SEQ ID NO: 6088 - protein, 9 aa, Homo Sapiens
APLEVYVCR

SEQ ID NO: 6089 - protein, 9 aa, Homo Sapiens
PSTLAPLEV

SEQ ID NO: 6090 - protein, 9 aa, Homo Sapiens
WIMTPSTLA

SEQ ID NO: 6091 - protein, 9 aa, Homo Sapiens
VPDGKGFRM

SEQ ID NO: 6092 - protein, 9 aa, Homo Sapiens
VPVPDGKGF

SEQ ID NO: 6093 - protein, 9 aa, Homo Sapiens
EFLSFVPVP

SEQ ID NO: 6094 - protein, 9 aa, Homo Sapiens
FLSFVPVPD

SEQ ID NO: 6095 - protein, 9 aa, Homo Sapiens
LSFVPVPDG

SEQ ID NO: 6096 - protein, 9 aa, Homo Sapiens
SFVPVPDGK

SEQ ID NO: 6097 - protein, 9 aa, Homo Sapiens
PVPDGKGFR

SEQ ID NO: 6098 - protein, 9 aa, Homo Sapiens
DEFLSFVPV

SEQ ID NO: 6099 - protein, 9 aa, Homo Sapiens
FVPVPDGKG

SEQ ID NO: 6100 - protein, 9 aa, Homo Sapiens
GRILIGGNL

SEQ ID NO: 6101 - protein, 9 aa, Homo Sapiens
GRERADTRR

SEQ ID NO: 6102 - protein, 9 aa, Homo Sapiens
RRWRFDATL

SEQ ID NO: 6103 - protein, 9 aa, Homo Sapiens
GRRVTQVVR

SEQ ID NO: 6104 - protein, 9 aa, Homo Sapiens
PRLHGDEER

SEQ ID NO: 6105 - protein, 9 aa, Homo Sapiens
LRTQGPAAL

SEQ ID NO: 6106 - protein, 9 aa, Homo Sapiens
CRVRNNTCF

SEQ ID NO: 6107 - protein, 9 aa, Homo Sapiens
PRNGELQDF

SEQ ID NO: 6108 - protein, 9 aa, Homo Sapiens
PRDRSVSGL

SEQ ID NO: 6109 - protein, 9 aa, Homo Sapiens
VRDFLHAQK

SEQ ID NO: 6110 - protein, 9 aa, Homo Sapiens
NREVLKREL

SEQ ID NO: 6111 - protein, 9 aa, Homo Sapiens
ERKKATAFF

SEQ ID NO: 6112 - protein, 9 aa, Homo Sapiens
WRFDATLEI

SEQ ID NO: 6113 - protein, 9 aa, Homo Sapiens
YRHVLGQDK

SEQ ID NO: 6114 - protein, 9 aa, Homo Sapiens
ERADTRRWR

SEQ ID NO: 6115 - protein, 9 aa, Homo Sapiens
RFFVEGLSF

SEQ ID NO: 6116 - protein, 9 aa, Homo Sapiens
RWIQDEMEL

SEQ ID NO: 6117 - protein, 9 aa, Homo Sapiens
GNLPGSSGR

SEQ ID NO: 6118 - protein, 9 aa, Homo Sapiens
RTQGPAALF

SEQ ID NO: 6119 - protein, 9 aa, Homo Sapiens
AGFTGLISF

SEQ ID NO: 6120 - protein, 9 aa, Homo Sapiens
RSVSGLDSF

SEQ ID NO: 6121 - protein, 9 aa, Homo Sapiens
RRVTQVVRD

SEQ ID NO: 6122 - protein, 9 aa, Homo Sapiens
RSLLEPLGL

SEQ ID NO: 6123 - protein, 9 aa, Homo Sapiens
ATLEIIVVM

SEQ ID NO: 6124 - protein, 9 aa, Homo Sapiens
GILLVNCDR

SEQ ID NO: 6125 - protein, 9 aa, Homo Sapiens
RLHGDEERF

SEQ ID NO: 6126 - protein, 9 aa, Homo Sapiens
GFTGLISFH

SEQ ID NO: 6127 - protein, 9 aa, Homo Sapiens
GELQDFPYK

SEQ ID NO: 6128 - protein, 9 aa, Homo Sapiens
RILGPDFGY

SEQ ID NO: 6129 - protein, 9 aa, Homo Sapiens
RVTQVVRDF

SEQ ID NO: 6130 - protein, 9 aa, Homo Sapiens
ACFKLFQEK

SEQ ID NO: 6131 - protein, 9 aa, Homo Sapiens
KRELGLAEC

SEQ ID NO: 6132 - protein, 9 aa, Homo Sapiens
RIVRVSLEH

SEQ ID NO: 6133 - protein, 9 aa, Homo Sapiens
GSVPEGTEM

SEQ ID NO: 6134 - protein, 9 aa, Homo Sapiens
IYISPNMER

SEQ ID NO: 6135 - protein, 9 aa, Homo Sapiens
RGRERADTR

SEQ ID NO: 6136 - protein, 9 aa, Homo Sapiens
RADTRRWRF

SEQ ID NO: 6137 - protein, 9 aa, Homo Sapiens
KVSYEVPRL

SEQ ID NO: 6138 - protein, 9 aa, Homo Sapiens
GLISFHVTL

SEQ ID NO: 6139 - protein, 9 aa, Homo Sapiens
KRILGPDFG

SEQ ID NO: 6140 - protein, 9 aa, Homo Sapiens
GPDFGYVTR

SEQ ID NO: 6141 - protein, 9 aa, Homo Sapiens
GHVDEFLSF

SEQ ID NO: 6142 - protein, 9 aa, Homo Sapiens
KTISINQVL

SEQ ID NO: 6143 - protein, 9 aa, Homo Sapiens
SINQVLSNK

SEQ ID NO: 6144 - protein, 9 aa, Homo Sapiens
KDLINYNKF

SEQ ID NO: 6145 - protein, 9 aa, Homo Sapiens
CDIIDIPQL

SEQ ID NO: 6146 - protein, 9 aa, Homo Sapiens
QLFKTERKK

SEQ ID NO: 6147 - protein, 9 aa, Homo Sapiens
AFFPDLVNM

SEQ ID NO: 6148 - protein, 9 aa, Homo Sapiens
KHLGIPKPF

SEQ ID NO: 6149 - protein, 9 aa, Homo Sapiens
AALFDDHKL

SEQ ID NO: 6150 - protein, 9 aa, Homo Sapiens
GLSFPDAGF

SEQ ID NO: 6151 - protein, 9 aa, Homo Sapiens
DAVAELARK

SEQ ID NO: 6152 - protein, 9 aa, Homo Sapiens
KEYPLGRIL

SEQ ID NO: 6153 - protein, 9 aa, Homo Sapiens
NLPGSSGRR

SEQ ID NO: 6154 - protein, 9 aa, Homo Sapiens
QKVQPPVEL

SEQ ID NO: 6155 - protein, 9 aa, Homo Sapiens
NKDLINYNK

SEQ ID NO: 6156 - protein, 9 aa, Homo Sapiens
IPQLFKTER

SEQ ID NO: 6157 - protein, 9 aa, Homo Sapiens
TERKKATAF

SEQ ID NO: 6158 - protein, 9 aa, Homo Sapiens
EPLGLHCTF

SEQ ID NO: 6159 - protein, 9 aa, Homo Sapiens
VCVAGVETL

SEQ ID NO: 6160 - protein, 9 aa, Homo Sapiens
VDIYISPNM

SEQ ID NO: 6161 - protein, 9 aa, Homo Sapiens
GRQDRNFVD

SEQ ID NO: 6162 - protein, 9 aa, Homo Sapiens
RQDRNFVDK

SEQ ID NO: 6163 - protein, 9 aa, Homo Sapiens
GPSGYGGIL

SEQ ID NO: 6164 - protein, 9 aa, Homo Sapiens
KRAQVFHIC

SEQ ID NO: 6165 - protein, 9 aa, Homo Sapiens
EDFSASPIF

SEQ ID NO: 6166 - protein, 9 aa, Homo Sapiens
PIFTDTVVF

SEQ ID NO: 6167 - protein, 9 aa, Homo Sapiens
PPLEVYVCR

SEQ ID NO: 6168 - protein, 9 aa, Homo Sapiens
RKAGCKLTI

SEQ ID NO: 6169 - protein, 9 aa, Homo Sapiens
QDFPYKRIL

SEQ ID NO: 6170 - protein, 9 aa, Homo Sapiens
SGLDSFGNL

SEQ ID NO: 6171 - protein, 9 aa, Homo Sapiens
KVQPPVELF

SEQ ID NO: 6172 - protein, 9 aa, Homo Sapiens
LAVGHVDEF

SEQ ID NO: 6173 - protein, 9 aa, Homo Sapiens
ASPGACFKL

SEQ ID NO: 6174 - protein, 9 aa, Homo Sapiens
KCGHGRALL

SEQ ID NO: 6175 - protein, 9 aa, Homo Sapiens
GRALLFQGV

SEQ ID NO: 6176 - protein, 9 aa, Homo Sapiens
GVVDDEQVK

SEQ ID NO: 6177 - protein, 9 aa, Homo Sapiens
VQSCIDWNR

SEQ ID NO: 6178 - protein, 9 aa, Homo Sapiens
DWNREVLKR

SEQ ID NO: 6179 - protein, 9 aa, Homo Sapiens
EVLKRELGL

SEQ ID NO: 6180 - protein, 9 aa, Homo Sapiens
IIDIPQLFK

SEQ ID NO: 6181 - protein, 9 aa, Homo Sapiens
PQLFKTERK

SEQ ID NO: 6182 - protein, 9 aa, Homo Sapiens
QRIVRVSLE

SEQ ID NO: 6183 - protein, 9 aa, Homo Sapiens
GTPGVDIYI

SEQ ID NO: 6184 - protein, 9 aa, Homo Sapiens
YLTCVDISL

SEQ ID NO: 6185 - protein, 9 aa, Homo Sapiens
VDISLDCDL

SEQ ID NO: 6186 - protein, 9 aa, Homo Sapiens
DRNFVDKRQ

SEQ ID NO: 6187 - protein, 9 aa, Homo Sapiens
LEDMSVMVL

SEQ ID NO: 6188 - protein, 9 aa, Homo Sapiens
KLVLHTSSY

SEQ ID NO: 6189 - protein, 9 aa, Homo Sapiens
HTSSYDAKR

SEQ ID NO: 6190 - protein, 9 aa, Homo Sapiens
YDAKRAQVF

SEQ ID NO: 6191 - protein, 9 aa, Homo Sapiens
EDVCEAYRH

SEQ ID NO: 6192 - protein, 9 aa, Homo Sapiens
ERFFVEGLS

SEQ ID NO: 6193 - protein, 9 aa, Homo Sapiens
FPDAGFTGL

SEQ ID NO: 6194 - protein, 9 aa, Homo Sapiens
PWIMTPSTL

SEQ ID NO: 6195 - protein, 9 aa, Homo Sapiens
STLPPLEVY

SEQ ID NO: 6196 - protein, 9 aa, Homo Sapiens
CFVDAVAEL

SEQ ID NO: 6197 - protein, 9 aa, Homo Sapiens
LARKAGCKL

SEQ ID NO: 6198 - protein, 9 aa, Homo Sapiens
TICPQAENR

SEQ ID NO: 6199 - protein, 9 aa, Homo Sapiens
LGYVQAPHK

SEQ ID NO: 6200 - protein, 9 aa, Homo Sapiens
VANGKEYPL

SEQ ID NO: 6201 - protein, 9 aa, Homo Sapiens
APDGKGFRM

SEQ ID NO: 6202 - protein, 9 aa, Homo Sapiens
PDGKGFRML

SEQ ID NO: 6203 - protein, 9 aa, Homo Sapiens
FRMLLASPG

SEQ ID NO: 6204 - protein, 9 aa, Homo Sapiens
LASPGACFK

SEQ ID NO: 6205 - protein, 9 aa, Homo Sapiens
CGHGRALLF

SEQ ID NO: 6206 - protein, 9 aa, Homo Sapiens
NQVLSNKDL

SEQ ID NO: 6207 - protein, 9 aa, Homo Sapiens
LSNKDLINY

SEQ ID NO: 6208 - protein, 9 aa, Homo Sapiens
PDLVNMLVL

SEQ ID NO: 6209 - protein, 9 aa, Homo Sapiens
KPFGPIING

SEQ ID NO: 6210 - protein, 9 aa, Homo Sapiens
PIINGCCCL

SEQ ID NO: 6211 - protein, 9 aa, Homo Sapiens
CLEEKVRSL

SEQ ID NO: 6212 - protein, 9 aa, Homo Sapiens
LEEKVRSLL

SEQ ID NO: 6213 - protein, 9 aa, Homo Sapiens
KVRSLLEPL

SEQ ID NO: 6214 - protein, 9 aa, Homo Sapiens
DDFTPYHML

SEQ ID NO: 6215 - protein, 9 aa, Homo Sapiens
VHCGTNVCR

SEQ ID NO: 6216 - protein, 9 aa, Homo Sapiens
VCRKPFSFK

SEQ ID NO: 6217 - protein, 9 aa, Homo Sapiens
CRKPFSFKW

SEQ ID NO: 6218 - protein, 9 aa, Homo Sapiens
LQRIVRVSL

SEQ ID NO: 6219 - protein, 9 aa, Homo Sapiens
GVETLVDIY

SEQ ID NO: 6220 - protein, 9 aa, Homo Sapiens
SVPEGTEMF

SEQ ID NO: 6221 - protein, 9 aa, Homo Sapiens
VMNSPSNDL

SEQ ID NO: 6222 - protein, 9 aa, Homo Sapiens
NDSHVQISY

SEQ ID NO: 6223 - protein, 9 aa, Homo Sapiens
PLPLAYAVL

SEQ ID NO: 6224 - protein, 9 aa, Homo Sapiens
LNCEGRQDR

SEQ ID NO: 6225 - protein, 9 aa, Homo Sapiens
CEGRQDRNF

SEQ ID NO: 6226 - protein, 9 aa, Homo Sapiens
QDRNFVDKR

SEQ ID NO: 6227 - protein, 9 aa, Homo Sapiens
KRQWVWGPS

SEQ ID NO: 6228 - protein, 9 aa, Homo Sapiens
PSGYGGILL

SEQ ID NO: 6229 - protein, 9 aa, Homo Sapiens
NCDQHVHCL

SEQ ID NO: 6230 - protein, 9 aa, Homo Sapiens
HCLQDLEDM

SEQ ID NO: 6231 - protein, 9 aa, Homo Sapiens
QDLEDMSVM

SEQ ID NO: 6232 - protein, 9 aa, Homo Sapiens
LFDDHKLVL

SEQ ID NO: 6233 - protein, 9 aa, Homo Sapiens
VLGQDKVSY

SEQ ID NO: 6234 - protein, 9 aa, Homo Sapiens
LISFHVTLL

SEQ ID NO: 6235 - protein, 9 aa, Homo Sapiens
IFTDTVVFR

SEQ ID NO: 6236 - protein, 9 aa, Homo Sapiens
FRVAPWIMT

SEQ ID NO: 6237 - protein, 9 aa, Homo Sapiens
LEVYVCRVR

SEQ ID NO: 6238 - protein, 9 aa, Homo Sapiens
ARKAGCKLT

SEQ ID NO: 6239 - protein, 9 aa, Homo Sapiens
PHKTLPVVF

SEQ ID NO: 6240 - protein, 9 aa, Homo Sapiens
LPVVFDSPR

SEQ ID NO: 6241 - protein, 9 aa, Homo Sapiens
FDSPRNGEL

SEQ ID NO: 6242 - protein, 9 aa, Homo Sapiens
ELQDFPYKR

SEQ ID NO: 6243 - protein, 9 aa, Homo Sapiens
TREPRDRSV

SEQ ID NO: 6244 - protein, 9 aa, Homo Sapiens
SPPVVANGK

SEQ ID NO: 6245 - protein, 9 aa, Homo Sapiens
GKEYPLGRI

SEQ ID NO: 6246 - protein, 9 aa, Homo Sapiens
AVGHVDEFL

SEQ ID NO: 6247 - protein, 9 aa, Homo Sapiens
PAPDGKGFR

SEQ ID NO: 6248 - protein, 9 aa, Homo Sapiens
DGKGFRMLL

SEQ ID NO: 6249 - protein, 9 aa, Homo Sapiens
FKLFQEKQK

SEQ ID NO: 6250 - protein, 9 aa, Homo Sapiens
DIIDIPQLF

SEQ ID NO: 6251 - protein, 9 aa, Homo Sapiens
KATAFFPDL

SEQ ID NO: 6252 - protein, 9 aa, Homo Sapiens
FFPDLVNML

SEQ ID NO: 6253 - protein, 9 aa, Homo Sapiens
LVNMLVLGK

SEQ ID NO: 6254 - protein, 9 aa, Homo Sapiens
VNMLVLGKH

SEQ ID NO: 6255 - protein, 9 aa, Homo Sapiens
NMLVLGKHL

SEQ ID NO: 6256 - protein, 9 aa, Homo Sapiens
CCCLEEKVR

SEQ ID NO: 6257 - protein, 9 aa, Homo Sapiens
VRSLLEPLG

SEQ ID NO: 6258 - protein, 9 aa, Homo Sapiens
SLLEPLGLH

SEQ ID NO: 6259 - protein, 9 aa, Homo Sapiens
LHCTFIDDF

SEQ ID NO: 6260 - protein, 9 aa, Homo Sapiens
HCGTNVCRK

SEQ ID NO: 6261 - protein, 9 aa, Homo Sapiens
GTNVCRKPF

SEQ ID NO: 6262 - protein, 9 aa, Homo Sapiens
VRVSLEHPT

SEQ ID NO: 6263 - protein, 9 aa, Homo Sapiens
YGTPGVDIY

SEQ ID NO: 6264 - protein, 9 aa, Homo Sapiens
PNMERGRER

SEQ ID NO: 6265 - protein, 9 aa, Homo Sapiens
ERGRERADT

SEQ ID NO: 6266 - protein, 9 aa, Homo Sapiens
DSHVQISYH

SEQ ID NO: 6267 - protein, 9 aa, Homo Sapiens
VQISYHSSH

SEQ ID NO: 6268 - protein, 9 aa, Homo Sapiens
HSSHEPLPL

SEQ ID NO: 6269 - protein, 9 aa, Homo Sapiens
LPLAYAVLY

SEQ ID NO: 6270 - protein, 9 aa, Homo Sapiens
PLAYAVLYL

SEQ ID NO: 6271 - protein, 9 aa, Homo Sapiens
QWVWGPSGY

SEQ ID NO: 6272 - protein, 9 aa, Homo Sapiens
DRDDPSCDV

SEQ ID NO: 6273 - protein, 9 aa, Homo Sapiens
QHVHCLQDL

SEQ ID NO: 6274 - protein, 9 aa, Homo Sapiens
EDMSVMVLR

SEQ ID NO: 6275 - protein, 9 aa, Homo Sapiens
GPAALFDDH

SEQ ID NO: 6276 - protein, 9 aa, Homo Sapiens
PAALFDDHK

SEQ ID NO: 6277 - protein, 9 aa, Homo Sapiens
GPEDVCEAY

SEQ ID NO: 6278 - protein, 9 aa, Homo Sapiens
RHVLGQDKV

SEQ ID NO: 6279 - protein, 9 aa, Homo Sapiens
DKVSYEVPR

SEQ ID NO: 6280 - protein, 9 aa, Homo Sapiens
VSYEVPRLH

SEQ ID NO: 6281 - protein, 9 aa, Homo Sapiens
LLDDSNEDF

SEQ ID NO: 6282 - protein, 9 aa, Homo Sapiens
VVFRVAPWI

SEQ ID NO: 6283 - protein, 9 aa, Homo Sapiens
MTPSTLPPL

SEQ ID NO: 6284 - protein, 9 aa, Homo Sapiens
ELARKAGCK

SEQ ID NO: 6285 - protein, 9 aa, Homo Sapiens
PQAENRNDR

SEQ ID NO: 6286 - protein, 9 aa, Homo Sapiens
NRNDRWIQD

SEQ ID NO: 6287 - protein, 9 aa, Homo Sapiens
NDRWIQDEM

SEQ ID NO: 6288 - protein, 9 aa, Homo Sapiens
ELGYVQAPH

SEQ ID NO: 6289 - protein, 9 aa, Homo Sapiens
YVQAPHKTL

SEQ ID NO: 6290 - protein, 9 aa, Homo Sapiens
YKRILGPDF

SEQ ID NO: 6291 - protein, 9 aa, Homo Sapiens
FGYVTREPR

SEQ ID NO: 6292 - protein, 9 aa, Homo Sapiens
DRSVSGLDS

SEQ ID NO: 6293 - protein, 9 aa, Homo Sapiens
NGKEYPLGR

SEQ ID NO: 6294 - protein, 9 aa, Homo Sapiens
PVELFVDWL

SEQ ID NO: 6295 - protein, 9 aa, Homo Sapiens
SFVPAPDGK

SEQ ID NO: 6296 - protein, 9 aa, Homo Sapiens
LLASPGACF

SEQ ID NO: 6297 - protein, 9 aa, Homo Sapiens
EKQKCGHGR

SEQ ID NO: 6298 - protein, 9 aa, Homo Sapiens
QKCGHGRAL

SEQ ID NO: 6299 - protein, 9 aa, Homo Sapiens
IDWNREVLK

SEQ ID NO: 6300 - protein, 9 aa, Homo Sapiens
LVLGKHLGI

SEQ ID NO: 6301 - protein, 9 aa, Homo Sapiens
LGKHLGIPK

SEQ ID NO: 6302 - protein, 9 aa, Homo Sapiens
GKHLGIPKP

SEQ ID NO: 6303 - protein, 9 aa, Homo Sapiens
GIPKPFGPI

SEQ ID NO: 6304 - protein, 9 aa, Homo Sapiens
NGCCCLEEK

SEQ ID NO: 6305 - protein, 9 aa, Homo Sapiens
TFIDDFTPY

SEQ ID NO: 6306 - protein, 9 aa, Homo Sapiens
NVCRKPFSF

SEQ ID NO: 6307 - protein, 9 aa, Homo Sapiens
PFSFKWWNM

SEQ ID NO: 6308 - protein, 9 aa, Homo Sapiens
AGVETLVDI

SEQ ID NO: 6309 - protein, 9 aa, Homo Sapiens
ISPNMERGR

SEQ ID NO: 6310 - protein, 9 aa, Homo Sapiens
RFDATLEII

SEQ ID NO: 6311 - protein, 9 aa, Homo Sapiens
PSNDLNDSH

SEQ ID NO: 6312 - protein, 9 aa, Homo Sapiens
SYHSSHEPL

SEQ ID NO: 6313 - protein, 9 aa, Homo Sapiens
SHEPLPLAY

SEQ ID NO: 6314 - protein, 9 aa, Homo Sapiens
DCDLNCEGR

SEQ ID NO: 6315 - protein, 9 aa, Homo Sapiens
QDNCDQHVH

SEQ ID NO: 6316 - protein, 9 aa, Homo Sapiens
FDDHKLVLH

SEQ ID NO: 6317 - protein, 9 aa, Homo Sapiens
LHTSSYDAK

SEQ ID NO: 6318 - protein, 9 aa, Homo Sapiens
DAKRAQVFH

SEQ ID NO: 6319 - protein, 9 aa, Homo Sapiens
PEDVCEAYR

SEQ ID NO: 6320 - protein, 9 aa, Homo Sapiens
VCEAYRHVL

SEQ ID NO: 6321 - protein, 9 aa, Homo Sapiens
LHGDEERFF

SEQ ID NO: 6322 - protein, 9 aa, Homo Sapiens
EERFFVEGL

SEQ ID NO: 6323 - protein, 9 aa, Homo Sapiens
VRNNTCFVD

SEQ ID NO: 6324 - protein, 9 aa, Homo Sapiens
VDAVAELAR

SEQ ID NO: 6325 - protein, 9 aa, Homo Sapiens
DRWIQDEME

SEQ ID NO: 6326 - protein, 9 aa, Homo Sapiens
IQDEMELGY

SEQ ID NO: 6327 - protein, 9 aa, Homo Sapiens
YVTREPRDR

SEQ ID NO: 6328 - protein, 9 aa, Homo Sapiens
VTQVVRDFL

SEQ ID NO: 6329 - protein, 9 aa, Homo Sapiens
RDFLHAQKV

SEQ ID NO: 6330 - protein, 9 aa, Homo Sapiens
FVDWLAVGH

SEQ ID NO: 6331 - protein, 9 aa, Homo Sapiens
VPAPDGKGF

SEQ ID NO: 6332 - protein, 9 aa, Homo Sapiens
KLFQEKQKC

SEQ ID NO: 6333 - protein, 9 aa, Homo Sapiens
FQEKQKCGH

SEQ ID NO: 6334 - protein, 9 aa, Homo Sapiens
CIDWNREVL

SEQ ID NO: 6335 - protein, 9 aa, Homo Sapiens
MSLQRIVRV

SEQ ID NO: 6336 - protein, 9 aa, Homo Sapiens
EGTEMFEVY

SEQ ID NO: 6337 - protein, 9 aa, Homo Sapiens
TRRWRFDAT

SEQ ID NO: 6338 - protein, 9 aa, Homo Sapiens
VLYLTCVDI

SEQ ID NO: 6339 - protein, 9 aa, Homo Sapiens
SGYGGILLV

SEQ ID NO: 6340 - protein, 9 aa, Homo Sapiens
RVAPWIMTP

SEQ ID NO: 6341 - protein, 9 aa, Homo Sapiens
NGELQDFPY

SEQ ID NO: 6342 - protein, 9 aa, Homo Sapiens
PDFGYVTRE

SEQ ID NO: 6343 - protein, 9 aa, Homo Sapiens
PVVANGKEY

SEQ ID NO: 6344 - protein, 9 aa, Homo Sapiens
EYPLGRILI

SEQ ID NO: 6345 - protein, 9 aa, Homo Sapiens
TQVVRDFLH

SEQ ID NO: 6346 - protein, 9 aa, Homo Sapiens
SPGACFKLF

SEQ ID NO: 6347 - protein, 9 aa, Homo Sapiens
RALLFQGVV

SEQ ID NO: 6348 - protein, 9 aa, Homo Sapiens
YNKFVQSCI

SEQ ID NO: 6349 - protein, 9 aa, Homo Sapiens
RELGLAECD

SEQ ID NO: 6350 - protein, 9 aa, Homo Sapiens
LAECDIIDI

SEQ ID NO: 6351 - protein, 9 aa, Homo Sapiens
IDDFTPYHM

SEQ ID NO: 6352 - protein, 9 aa, Homo Sapiens
DFTPYHMLH

SEQ ID NO: 6353 - protein, 9 aa, Homo Sapiens
YHMLHGEVH

SEQ ID NO: 6354 - protein, 9 aa, Homo Sapiens
DLNDSHVQI

SEQ ID NO: 6355 - protein, 9 aa, Homo Sapiens
RNFVDKRQW

SEQ ID NO: 6356 - protein, 9 aa, Homo Sapiens
GYGGILLVN

SEQ ID NO: 6357 - protein, 9 aa, Homo Sapiens
GGILLVNCD

SEQ ID NO: 6358 - protein, 9 aa, Homo Sapiens
DVQDNCDQH

SEQ ID NO: 6359 - protein, 9 aa, Homo Sapiens
GQDKVSYEV

SEQ ID NO: 6360 - protein, 9 aa, Homo Sapiens
NEDFSASPI

SEQ ID NO: 6361 - protein, 9 aa, Homo Sapiens
VFRVAPWIM

SEQ ID NO: 6362 - protein, 9 aa, Homo Sapiens
LQDFPYKRI

SEQ ID NO: 6363 - protein, 9 aa, Homo Sapiens
GNLEVSPPV

SEQ ID NO: 6364 - protein, 9 aa, Homo Sapiens
RILIGGNLP

SEQ ID NO: 6365 - protein, 9 aa, Homo Sapiens
ILIGGNLPG

SEQ ID NO: 6366 - protein, 9 aa, Homo Sapiens
RMLLASPGA

SEQ ID NO: 6367 - protein, 9 aa, Homo Sapiens
LLFQGVVDD

SEQ ID NO: 6368 - protein, 9 aa, Homo Sapiens
VDDEQVKTI

SEQ ID NO: 6369 - protein, 9 aa, Homo Sapiens
DEQVKTISI

SEQ ID NO: 6370 - protein, 9 aa, Homo Sapiens
QVLSNKDLI

SEQ ID NO: 6371 - protein, 9 aa, Homo Sapiens
LGLAECDII

SEQ ID NO: 6372 - protein, 9 aa, Homo Sapiens
IPKPFGPII

SEQ ID NO: 6373 - protein, 9 aa, Homo Sapiens
PLGLHCTFI

SEQ ID NO: 6374 - protein, 9 aa, Homo Sapiens
FIDDFTPYH

SEQ ID NO: 6375 - protein, 9 aa, Homo Sapiens
RVSLEHPTS

SEQ ID NO: 6376 - protein, 9 aa, Homo Sapiens
DIYGSVPEG

SEQ ID NO: 6377 - protein, 9 aa, Homo Sapiens
VYGTPGVDI

SEQ ID NO: 6378 - protein, 9 aa, Homo Sapiens
WGPSGYGGI

SEQ ID NO: 6379 - protein, 9 aa, Homo Sapiens
AKRAQVFHI

SEQ ID NO: 6380 - protein, 9 aa, Homo Sapiens
PDAGFTGLI

SEQ ID NO: 6381 - protein, 9 aa, Homo Sapiens
AENRNDRWI

SEQ ID NO: 6382 - protein, 9 aa, Homo Sapiens
GYVQAPHKT

SEQ ID NO: 6383 - protein, 9 aa, Homo Sapiens
RNGELQDFP

SEQ ID NO: 6384 - protein, 9 aa, Homo Sapiens
FPYKRILGP

SEQ ID NO: 6385 - protein, 9 aa, Homo Sapiens
YPLGRILIG

SEQ ID NO: 6386 - protein, 9 aa, Homo Sapiens
CCLEEKVRS

SEQ ID NO: 6387 - protein, 9 aa, Homo Sapiens
GEVHCGTNV

SEQ ID NO: 6388 - protein, 9 aa, Homo Sapiens
GVDIYISPN

SEQ ID NO: 6389 - protein, 9 aa, Homo Sapiens
RWRFDATLE

SEQ ID NO: 6390 - protein, 9 aa, Homo Sapiens
DATLEIIVV

SEQ ID NO: 6391 - protein, 9 aa, Homo Sapiens
LEIIVVMNS

SEQ ID NO: 6392 - protein, 9 aa, Homo Sapiens
ISLDCDLNC

SEQ ID NO: 6393 - protein, 9 aa, Homo Sapiens
RDDPSCDVQ

SEQ ID NO: 6394 - protein, 9 aa, Homo Sapiens
VTLLDDSNE

SEQ ID NO: 6395 - protein, 9 aa, Homo Sapiens
GCKLTICPQ

SEQ ID NO: 6396 - protein, 9 aa, Homo Sapiens
LTICPQAEN

SEQ ID NO: 6397 - protein, 9 aa, Homo Sapiens
RNDRWIQDE

SEQ ID NO: 6398 - protein, 9 aa, Homo Sapiens
KTLPVVFDS

SEQ ID NO: 6399 - protein, 9 aa, Homo Sapiens
GYVTREPRD

SEQ ID NO: 6400 - protein, 9 aa, Homo Sapiens
DSFGNLEVS

SEQ ID NO: 6401 - protein, 9 aa, Homo Sapiens
GGNLPGSSG

SEQ ID NO: 6402 - protein, 9 aa, Homo Sapiens
GSSGRRVTQ

SEQ ID NO: 6403 - protein, 9 aa, Homo Sapiens
KGFRMLLAS

SEQ ID NO: 6404 - protein, 9 aa, Homo Sapiens
GFRMLLASP

SEQ ID NO: 6405 - protein, 9 aa, Homo Sapiens
EQVKTISIN

SEQ ID NO: 6406 - protein, 9 aa, Homo Sapiens
KFVQSCIDW

SEQ ID NO: 6407 - protein, 9 aa, Homo Sapiens
REVLKRELG

SEQ ID NO: 6408 - protein, 9 aa, Homo Sapiens
ELGLAECDI

SEQ ID NO: 6409 - protein, 9 aa, Homo Sapiens
IDIPQLFKT

SEQ ID NO: 6410 - protein, 9 aa, Homo Sapiens
TAFFPDLVN

SEQ ID NO: 6411 - protein, 9 aa, Homo Sapiens
KPFSFKWWN

SEQ ID NO: 6412 - protein, 9 aa, Homo Sapiens
VSLEHPTSA

SEQ ID NO: 6413 - protein, 9 aa, Homo Sapiens
ETLVDIYGS

SEQ ID NO: 6414 - protein, 9 aa, Homo Sapiens
VDIYGSVPE

SEQ ID NO: 6415 - protein, 9 aa, Homo Sapiens
EMFEVYGTP

SEQ ID NO: 6416 - protein, 9 aa, Homo Sapiens
RERADTRRW

SEQ ID NO: 6417 - protein, 9 aa, Homo Sapiens
SHVQISYHS

SEQ ID NO: 6418 - protein, 9 aa, Homo Sapiens
ISYHSSHEP

SEQ ID NO: 6419 - protein, 9 aa, Homo Sapiens
EPLPLAYAV

SEQ ID NO: 6420 - protein, 9 aa, Homo Sapiens
NCEGRQDRN

SEQ ID NO: 6421 - protein, 9 aa, Homo Sapiens
FVDKRQWVW

SEQ ID NO: 6422 - protein, 9 aa, Homo Sapiens
RQWVWGPSG

SEQ ID NO: 6423 - protein, 9 aa, Homo Sapiens
HKLVLHTSS

SEQ ID NO: 6424 - protein, 9 aa, Homo Sapiens
HVLGQDKVS

SEQ ID NO: 6425 - protein, 9 aa, Homo Sapiens
FFVEGLSFP

SEQ ID NO: 6426 - protein, 9 aa, Homo Sapiens
ISFHVTLLD

SEQ ID NO: 6427 - protein, 9 aa, Homo Sapiens
SPIFTDTVV

SEQ ID NO: 6428 - protein, 9 aa, Homo Sapiens
AVAELARKA

SEQ ID NO: 6429 - protein, 9 aa, Homo Sapiens
KAGCKLTIC

SEQ ID NO: 6430 - protein, 9 aa, Homo Sapiens
ICPQAENRN

SEQ ID NO: 6431 - protein, 9 aa, Homo Sapiens
APHKTLPVV

SEQ ID NO: 6432 - protein, 9 aa, Homo Sapiens
VVFDSPRNG

SEQ ID NO: 6433 - protein, 9 aa, Homo Sapiens
REPRDRSVS

SEQ ID NO: 6434 - protein, 9 aa, Homo Sapiens
RDRSVSGLD

SEQ ID NO: 6435 - protein, 9 aa, Homo Sapiens
VSPPVVANG

SEQ ID NO: 6436 - protein, 9 aa, Homo Sapiens
HAQKVQPPV

SEQ ID NO: 6437 - protein, 9 aa, Homo Sapiens
DEFLSFVPA

SEQ ID NO: 6438 - protein, 9 aa, Homo Sapiens
LSFVPAPDG

SEQ ID NO: 6439 - protein, 9 aa, Homo Sapiens
GACFKLFQE

SEQ ID NO: 6440 - protein, 9 aa, Homo Sapiens
KQKCGHGRA

SEQ ID NO: 6441 - protein, 9 aa, Homo Sapiens
VVDDEQVKT

SEQ ID NO: 6442 - protein, 9 aa, Homo Sapiens
DDEQVKTIS

SEQ ID NO: 6443 - protein, 9 aa, Homo Sapiens
VKTISINQV

SEQ ID NO: 6444 - protein, 9 aa, Homo Sapiens
ISINQVLSN

SEQ ID NO: 6445 - protein, 9 aa, Homo Sapiens
INQVLSNKD

SEQ ID NO: 6446 - protein, 9 aa, Homo Sapiens
INYNKFVQS

SEQ ID NO: 6447 - protein, 9 aa, Homo Sapiens
GLAECDIID

SEQ ID NO: 6448 - protein, 9 aa, Homo Sapiens
KTERKKATA

SEQ ID NO: 6449 - protein, 9 aa, Homo Sapiens
PFGPIINGC

SEQ ID NO: 6450 - protein, 9 aa, Homo Sapiens
GCCCLEEKV

SEQ ID NO: 6451 - protein, 9 aa, Homo Sapiens
FSFKWWNMV

SEQ ID NO: 6452 - protein, 9 aa, Homo Sapiens
CVAGVETLV

SEQ ID NO: 6453 - protein, 9 aa, Homo Sapiens
EVYGTPGVD

SEQ ID NO: 6454 - protein, 9 aa, Homo Sapiens
EIIVVMNSP

SEQ ID NO: 6455 - protein, 9 aa, Homo Sapiens
IVVMNSPSN

SEQ ID NO: 6456 - protein, 9 aa, Homo Sapiens
LAYAVLYLT

SEQ ID NO: 6457 - protein, 9 aa, Homo Sapiens
YAVLYLTCV

SEQ ID NO: 6458 - protein, 9 aa, Homo Sapiens
AVLYLTCVD

SEQ ID NO: 6459 - protein, 9 aa, Homo Sapiens
YGGILLVNC

SEQ ID NO: 6460 - protein, 9 aa, Homo Sapiens
ILLVNCDRD

SEQ ID NO: 6461 - protein, 9 aa, Homo Sapiens
PSCDVQDNC

SEQ ID NO: 6462 - protein, 9 aa, Homo Sapiens
LQDLEDMSV

SEQ ID NO: 6463 - protein, 9 aa, Homo Sapiens
DDHKLVLHT

SEQ ID NO: 6464 - protein, 9 aa, Homo Sapiens
RAQVFHICG

SEQ ID NO: 6465 - protein, 9 aa, Homo Sapiens
AQVFHICGP

SEQ ID NO: 6466 - protein, 9 aa, Homo Sapiens
ICGPEDVCE

SEQ ID NO: 6467 - protein, 9 aa, Homo Sapiens
GDEERFFVE

SEQ ID NO: 6468 - protein, 9 aa, Homo Sapiens
LSFPDAGFT

SEQ ID NO: 6469 - protein, 9 aa, Homo Sapiens
TLLDDSNED

SEQ ID NO: 6470 - protein, 9 aa, Homo Sapiens
FSASPIFTD

SEQ ID NO: 6471 - protein, 9 aa, Homo Sapiens
LPPLEVYVC

SEQ ID NO: 6472 - protein, 9 aa, Homo Sapiens
EVYVCRVRN

SEQ ID NO: 6473 - protein, 9 aa, Homo Sapiens
RNNTCFVDA

SEQ ID NO: 6474 - protein, 9 aa, Homo Sapiens
TCFVDAVAE

SEQ ID NO: 6475 - protein, 9 aa, Homo Sapiens
AELARKAGC

SEQ ID NO: 6476 - protein, 9 aa, Homo Sapiens
AGCKLTICP

SEQ ID NO: 6477 - protein, 9 aa, Homo Sapiens
CKLTICPQA

SEQ ID NO: 6478 - protein, 9 aa, Homo Sapiens
EMELGYVQA

SEQ ID NO: 6479 - protein, 9 aa, Homo Sapiens
MELGYVQAP

SEQ ID NO: 6480 - protein, 9 aa, Homo Sapiens
PVVFDSPRN

SEQ ID NO: 6481 - protein, 9 aa, Homo Sapiens
SVSGLDSFG

SEQ ID NO: 6482 - protein, 9 aa, Homo Sapiens
LDSFGNLEV

SEQ ID NO: 6483 - protein, 9 aa, Homo Sapiens
ANGKEYPLG

SEQ ID NO: 6484 - protein, 9 aa, Homo Sapiens
DFLHAQKVQ

SEQ ID NO: 6485 - protein, 9 aa, Homo Sapiens
VELFVDWLA

SEQ ID NO: 6486 - protein, 9 aa, Homo Sapiens
CFKLFQEKQ

SEQ ID NO: 6487 - protein, 9 aa, Homo Sapiens
GHGRALLFQ

SEQ ID NO: 6488 - protein, 9 aa, Homo Sapiens
ALLFQGVVD

SEQ ID NO: 6489 - protein, 9 aa, Homo Sapiens
QVKTISINQ

SEQ ID NO: 6490 - protein, 9 aa, Homo Sapiens
SNKDLINYN

SEQ ID NO: 6491 - protein, 9 aa, Homo Sapiens
WNREVLKRE

SEQ ID NO: 6492 - protein, 9 aa, Homo Sapiens
AECDIIDIP

SEQ ID NO: 6493 - protein, 9 aa, Homo Sapiens
RKKATAFFP

SEQ ID NO: 6494 - protein, 9 aa, Homo Sapiens
MLVLGKHLG

SEQ ID NO: 6495 - protein, 9 aa, Homo Sapiens
GPIINGCCC

SEQ ID NO: 6496 - protein, 9 aa, Homo Sapiens
EKVRSLLEP

SEQ ID NO: 6497 - protein, 9 aa, Homo Sapiens
CTFIDDFTP

SEQ ID NO: 6498 - protein, 9 aa, Homo Sapiens
HMLHGEVHC

SEQ ID NO: 6499 - protein, 9 aa, Homo Sapiens
RKPFSFKWW

SEQ ID NO: 6500 - protein, 9 aa, Homo Sapiens
LEHPTSAVC

SEQ ID NO: 6501 - protein, 9 aa, Homo Sapiens
SAVCVAGVE

SEQ ID NO: 6502 - protein, 9 aa, Homo Sapiens
VETLVDIYG

SEQ ID NO: 6503 - protein, 9 aa, Homo Sapiens
GTEMFEVYG

SEQ ID NO: 6504 - protein, 9 aa, Homo Sapiens
FEVYGTPGV

SEQ ID NO: 6505 - protein, 9 aa, Homo Sapiens
TPGVDIYIS

SEQ ID NO: 6506 - protein, 9 aa, Homo Sapiens
PGVDIYISP

SEQ ID NO: 6507 - protein, 9 aa, Homo Sapiens
DIYISPNME

SEQ ID NO: 6508 - protein, 9 aa, Homo Sapiens
NMERGRERA

SEQ ID NO: 6509 - protein, 9 aa, Homo Sapiens
IIVVMNSPS

SEQ ID NO: 6510 - protein, 9 aa, Homo Sapiens
VVMNSPSND

SEQ ID NO: 6511 - protein, 9 aa, Homo Sapiens
NSPSNDLND

SEQ ID NO: 6512 - protein, 9 aa, Homo Sapiens
NDLNDSHVQ

SEQ ID NO: 6513 - protein, 9 aa, Homo Sapiens
SSHEPLPLA

SEQ ID NO: 6514 - protein, 9 aa, Homo Sapiens
HEPLPLAYA

SEQ ID NO: 6515 - protein, 9 aa, Homo Sapiens
AYAVLYLTC

SEQ ID NO: 6516 - protein, 9 aa, Homo Sapiens
LTCVDISLD

SEQ ID NO: 6517 - protein, 9 aa, Homo Sapiens
TCVDISLDC

SEQ ID NO: 6518 - protein, 9 aa, Homo Sapiens
CDLNCEGRQ

SEQ ID NO: 6519 - protein, 9 aa, Homo Sapiens
DKRQWVWGP

SEQ ID NO: 6520 - protein, 9 aa, Homo Sapiens
WVWGPSGYG

SEQ ID NO: 6521 - protein, 9 aa, Homo Sapiens
CDVQDNCDQ

SEQ ID NO: 6522 - protein, 9 aa, Homo Sapiens
VHCLQDLED

SEQ ID NO: 6523 - protein, 9 aa, Homo Sapiens
DMSVMVLRT

SEQ ID NO: 6524 - protein, 9 aa, Homo Sapiens
MSVMVLRTQ

SEQ ID NO: 6525 - protein, 9 aa, Homo Sapiens
SVMVLRTQG

SEQ ID NO: 6526 - protein, 9 aa, Homo Sapiens
MVLRTQGPA

SEQ ID NO: 6527 - protein, 9 aa, Homo Sapiens
ALFDDHKLV

SEQ ID NO: 6528 - protein, 9 aa, Homo Sapiens
DHKLVLHTS

SEQ ID NO: 6529 - protein, 9 aa, Homo Sapiens
LVLHTSSYD

SEQ ID NO: 6530 - protein, 9 aa, Homo Sapiens
QVFHICGPE

SEQ ID NO: 6531 - protein, 9 aa, Homo Sapiens
FHICGPEDV

SEQ ID NO: 6532 - protein, 9 aa, Homo Sapiens
HICGPEDVC

SEQ ID NO: 6533 - protein, 9 aa, Homo Sapiens
EAYRHVLGQ

SEQ ID NO: 6534 - protein, 9 aa, Homo Sapiens
AYRHVLGQD

SEQ ID NO: 6535 - protein, 9 aa, Homo Sapiens
FVEGLSFPD

SEQ ID NO: 6536 - protein, 9 aa, Homo Sapiens
TGLISFHVT

SEQ ID NO: 6537 - protein, 9 aa, Homo Sapiens
HVTLLDDSN

SEQ ID NO: 6538 - protein, 9 aa, Homo Sapiens
SASPIFTDT

SEQ ID NO: 6539 - protein, 9 aa, Homo Sapiens
FTDTVVFRV

SEQ ID NO: 6540 - protein, 9 aa, Homo Sapiens
WIMTPSTLP

SEQ ID NO: 6541 - protein, 9 aa, Homo Sapiens
IMTPSTLPP

SEQ ID NO: 6542 - protein, 9 aa, Homo Sapiens
PSTLPPLEV

SEQ ID NO: 6543 - protein, 9 aa, Homo Sapiens
VYVCRVRNN

SEQ ID NO: 6544 - protein, 9 aa, Homo Sapiens
YVCRVRNNT

SEQ ID NO: 6545 - protein, 9 aa, Homo Sapiens
RVRNNTCFV

SEQ ID NO: 6546 - protein, 9 aa, Homo Sapiens
NTCFVDAVA

SEQ ID NO: 6547 - protein, 9 aa, Homo Sapiens
CPQAENRND

SEQ ID NO: 6548 - protein, 9 aa, Homo Sapiens
DEMELGYVQ

SEQ ID NO: 6549 - protein, 9 aa, Homo Sapiens
VQAPHKTLP

SEQ ID NO: 6550 - protein, 9 aa, Homo Sapiens
HKTLPVVFD

SEQ ID NO: 6551 - protein, 9 aa, Homo Sapiens
SPRNGELQD

SEQ ID NO: 6552 - protein, 9 aa, Homo Sapiens
VTREPRDRS

SEQ ID NO: 6553 - protein, 9 aa, Homo Sapiens
GLDSFGNLE

SEQ ID NO: 6554 - protein, 9 aa, Homo Sapiens
FGNLEVSPP

SEQ ID NO: 6555 - protein, 9 aa, Homo Sapiens
LEVSPPVVA

SEQ ID NO: 6556 - protein, 9 aa, Homo Sapiens
EVSPPVVAN

SEQ ID NO: 6557 - protein, 9 aa, Homo Sapiens
PPVVANGKE

SEQ ID NO: 6558 - protein, 9 aa, Homo Sapiens
LGRILIGGN

SEQ ID NO: 6559 - protein, 9 aa, Homo Sapiens
LIGGNLPGS

SEQ ID NO: 6560 - protein, 9 aa, Homo Sapiens
SSGRRVTQV

SEQ ID NO: 6561 - protein, 9 aa, Homo Sapiens
LHAQKVQPP

SEQ ID NO: 6562 - protein, 9 aa, Homo Sapiens
PPVELFVDW

SEQ ID NO: 6563 - protein, 9 aa, Homo Sapiens
ELFVDWLAV

SEQ ID NO: 6564 - protein, 9 aa, Homo Sapiens
LFVDWLAVG

SEQ ID NO: 6565 - protein, 9 aa, Homo Sapiens
DWLAVGHVD

SEQ ID NO: 6566 - protein, 9 aa, Homo Sapiens
EFLSFVPAP

SEQ ID NO: 6567 - protein, 9 aa, Homo Sapiens
FVPAPDGKG

SEQ ID NO: 6568 - protein, 9 aa, Homo Sapiens
GKGFRMLLA

SEQ ID NO: 6569 - protein, 9 aa, Homo Sapiens
LFQEKQKCG

SEQ ID NO: 6570 - protein, 9 aa, Homo Sapiens
LFQGVVDDE

SEQ ID NO: 6571 - protein, 9 aa, Homo Sapiens
NYNKFVQSC

SEQ ID NO: 6572 - protein, 9 aa, Homo Sapiens
NKFVQSCID

SEQ ID NO: 6573 - protein, 9 aa, Homo Sapiens
SCIDWNREV

SEQ ID NO: 6574 - protein, 9 aa, Homo Sapiens
DIPQLFKTE

SEQ ID NO: 6575 - protein, 9 aa, Homo Sapiens
FPDLVNMLV

SEQ ID NO: 6576 - protein, 9 aa, Homo Sapiens
LGIPKPFGP

SEQ ID NO: 6577 - protein, 9 aa, Homo Sapiens
LEPLGLHCT

SEQ ID NO: 6578 - protein, 9 aa, Homo Sapiens
GLHCTFIDD

SEQ ID NO: 6579 - protein, 9 aa, Homo Sapiens
MLHGEVHCG

SEQ ID NO: 6580 - protein, 9 aa, Homo Sapiens
EVHCGTNVC

SEQ ID NO: 6581 - protein, 9 aa, Homo Sapiens
SLQRIVRVS

SEQ ID NO: 6582 - protein, 9 aa, Homo Sapiens
IVRVSLEHP

SEQ ID NO: 6583 - protein, 9 aa, Homo Sapiens
EHPTSAVCV

SEQ ID NO: 6584 - protein, 9 aa, Homo Sapiens
AVCVAGVET

SEQ ID NO: 6585 - protein, 9 aa, Homo Sapiens
VAGVETLVD

SEQ ID NO: 6586 - protein, 9 aa, Homo Sapiens
TLVDIYGSV

SEQ ID NO: 6587 - protein, 9 aa, Homo Sapiens
VPEGTEMFE

SEQ ID NO: 6588 - protein, 9 aa, Homo Sapiens
TEMFEVYGT

SEQ ID NO: 6589 - protein, 9 aa, Homo Sapiens
YISPNMERG

SEQ ID NO: 6590 - protein, 9 aa, Homo Sapiens
SPNMERGRE

SEQ ID NO: 6591 - protein, 9 aa, Homo Sapiens
TLEIIVVMN

SEQ ID NO: 6592 - protein, 9 aa, Homo Sapiens
MNSPSNDLN

SEQ ID NO: 6593 - protein, 9 aa, Homo Sapiens
SNDLNDSHV

SEQ ID NO: 6594 - protein, 9 aa, Homo Sapiens
LYLTCVDIS

SEQ ID NO: 6595 - protein, 9 aa, Homo Sapiens
LDCDLNCEG

SEQ ID NO: 6596 - protein, 9 aa, Homo Sapiens
EGRQDRNFV

SEQ ID NO: 6597 - protein, 9 aa, Homo Sapiens
VWGPSGYGG

SEQ ID NO: 6598 - protein, 9 aa, Homo Sapiens
NCDRDDPSC

SEQ ID NO: 6599 - protein, 9 aa, Homo Sapiens
DDPSCDVQD

SEQ ID NO: 6600 - protein, 9 aa, Homo Sapiens
HVHCLQDLE

SEQ ID NO: 6601 - protein, 9 aa, Homo Sapiens
TQGPAALFD

SEQ ID NO: 6602 - protein, 9 aa, Homo Sapiens
VLHTSSYDA

SEQ ID NO: 6603 - protein, 9 aa, Homo Sapiens
TSSYDAKRA

SEQ ID NO: 6604 - protein, 9 aa, Homo Sapiens
SSYDAKRAQ

SEQ ID NO: 6605 - protein, 9 aa, Homo Sapiens
SYDAKRAQV

SEQ ID NO: 6606 - protein, 9 aa, Homo Sapiens
CGPEDVCEA

SEQ ID NO: 6607 - protein, 9 aa, Homo Sapiens
LGQDKVSYE

SEQ ID NO: 6608 - protein, 9 aa, Homo Sapiens
YEVPRLHGD

SEQ ID NO: 6609 - protein, 9 aa, Homo Sapiens
VEGLSFPDA

SEQ ID NO: 6610 - protein, 9 aa, Homo Sapiens
FTGLISFHV

SEQ ID NO: 6611 - protein, 9 aa, Homo Sapiens
FHVTLLDDS

SEQ ID NO: 6612 - protein, 9 aa, Homo Sapiens
DDSNEDFSA

SEQ ID NO: 6613 - protein, 9 aa, Homo Sapiens
SNEDFSASP

SEQ ID NO: 6614 - protein, 9 aa, Homo Sapiens
TVVFRVAPW

SEQ ID NO: 6615 - protein, 9 aa, Homo Sapiens
VAPWIMTPS

SEQ ID NO: 6616 - protein, 9 aa, Homo Sapiens
APWIMTPST

SEQ ID NO: 6617 - protein, 9 aa, Homo Sapiens
TLPPLEVYV

SEQ ID NO: 6618 - protein, 9 aa, Homo Sapiens
PLEVYVCRV

SEQ ID NO: 6619 - protein, 9 aa, Homo Sapiens
VCRVRNNTC

SEQ ID NO: 6620 - protein, 9 aa, Homo Sapiens
QAENRNDRW

SEQ ID NO: 6621 - protein, 9 aa, Homo Sapiens
EPRDRSVSG

SEQ ID NO: 6622 - protein, 9 aa, Homo Sapiens
SFGNLEVSP

SEQ ID NO: 6623 - protein, 9 aa, Homo Sapiens
NLEVSPPVV

SEQ ID NO: 6624 - protein, 9 aa, Homo Sapiens
VVANGKEYP

SEQ ID NO: 6625 - protein, 9 aa, Homo Sapiens
PLGRILIGG

SEQ ID NO: 6626 - protein, 9 aa, Homo Sapiens
IGGNLPGSS

SEQ ID NO: 6627 - protein, 9 aa, Homo Sapiens
LPGSSGRRV

SEQ ID NO: 6628 - protein, 9 aa, Homo Sapiens
PGSSGRRVT

SEQ ID NO: 6629 - protein, 9 aa, Homo Sapiens
FLHAQKVQP

SEQ ID NO: 6630 - protein, 9 aa, Homo Sapiens
AQKVQPPVE

SEQ ID NO: 6631 - protein, 9 aa, Homo Sapiens
VQPPVELFV

SEQ ID NO: 6632 - protein, 9 aa, Homo Sapiens
QPPVELFVD

SEQ ID NO: 6633 - protein, 9 aa, Homo Sapiens
WLAVGHVDE

SEQ ID NO: 6634 - protein, 9 aa, Homo Sapiens
HVDEFLSFV

SEQ ID NO: 6635 - protein, 9 aa, Homo Sapiens
VDEFLSFVP

SEQ ID NO: 6636 - protein, 9 aa, Homo Sapiens
MLLASPGAC

SEQ ID NO: 6637 - protein, 9 aa, Homo Sapiens
QEKQKCGHG

SEQ ID NO: 6638 - protein, 9 aa, Homo Sapiens
HGRALLFQG

SEQ ID NO: 6639 - protein, 9 aa, Homo Sapiens
FQGVVDDEQ

SEQ ID NO: 6640 - protein, 9 aa, Homo Sapiens
QGVVDDEQV

SEQ ID NO: 6641 - protein, 9 aa, Homo Sapiens
TISINQVLS

SEQ ID NO: 6642 - protein, 9 aa, Homo Sapiens
VLSNKDLIN

SEQ ID NO: 6643 - protein, 9 aa, Homo Sapiens
DLINYNKFV

SEQ ID NO: 6644 - protein, 9 aa, Homo Sapiens
FVQSCIDWN

SEQ ID NO: 6645 - protein, 9 aa, Homo Sapiens
QSCIDWNRE

SEQ ID NO: 6646 - protein, 9 aa, Homo Sapiens
LKRELGLAE

SEQ ID NO: 6647 - protein, 9 aa, Homo Sapiens
ECDIIDIPQ

SEQ ID NO: 6648 - protein, 9 aa, Homo Sapiens
LFKTERKKA

SEQ ID NO: 6649 - protein, 9 aa, Homo Sapiens
DLVNMLVLG

SEQ ID NO: 6650 - protein, 9 aa, Homo Sapiens
VLGKHLGIP

SEQ ID NO: 6651 - protein, 9 aa, Homo Sapiens
HLGIPKPFG

SEQ ID NO: 6652 - protein, 9 aa, Homo Sapiens
PKPFGPIIN

SEQ ID NO: 6653 - protein, 9 aa, Homo Sapiens
IINGCCCLE

SEQ ID NO: 6654 - protein, 9 aa, Homo Sapiens
INGCCCLEE

SEQ ID NO: 6655 - protein, 9 aa, Homo Sapiens
LLEPLGLHC

SEQ ID NO: 6656 - protein, 9 aa, Homo Sapiens
TPYHMLHGE

SEQ ID NO: 6657 - protein, 9 aa, Homo Sapiens
CGTNVCRKP

SEQ ID NO: 6658 - protein, 9 aa, Homo Sapiens
TNVCRKPFS

SEQ ID NO: 6659 - protein, 9 aa, Homo Sapiens
SFKWWNMVP

SEQ ID NO: 6660 - protein, 9 aa, Homo Sapiens
SLEHPTSAV

SEQ ID NO: 6661 - protein, 9 aa, Homo Sapiens
HPTSAVCVA

SEQ ID NO: 6662 - protein, 9 aa, Homo Sapiens
PTSAVCVAG

SEQ ID NO: 6663 - protein, 9 aa, Homo Sapiens
TSAVCVAGV

SEQ ID NO: 6664 - protein, 9 aa, Homo Sapiens
LVDIYGSVP

SEQ ID NO: 6665 - protein, 9 aa, Homo Sapiens
IYGSVPEGT

SEQ ID NO: 6666 - protein, 9 aa, Homo Sapiens
YGSVPEGTE

SEQ ID NO: 6667 - protein, 9 aa, Homo Sapiens
PEGTEMFEV

SEQ ID NO: 6668 - protein, 9 aa, Homo Sapiens
MFEVYGTPG

SEQ ID NO: 6669 - protein, 9 aa, Homo Sapiens
MERGRERAD

SEQ ID NO: 6670 - protein, 9 aa, Homo Sapiens
FDATLEIIV

SEQ ID NO: 6671 - protein, 9 aa, Homo Sapiens
SPSNDLNDS

SEQ ID NO: 6672 - protein, 9 aa, Homo Sapiens
HVQISYHSS

SEQ ID NO: 6673 - protein, 9 aa, Homo Sapiens
QISYHSSHE

SEQ ID NO: 6674 - protein, 9 aa, Homo Sapiens
CVDISLDCD

SEQ ID NO: 6675 - protein, 9 aa, Homo Sapiens
SLDCDLNCE

SEQ ID NO: 6676 - protein, 9 aa, Homo Sapiens
DLNCEGRQD

SEQ ID NO: 6677 - protein, 9 aa, Homo Sapiens
NFVDKRQWV

SEQ ID NO: 6678 - protein, 9 aa, Homo Sapiens
LLVNCDRDD

SEQ ID NO: 6679 - protein, 9 aa, Homo Sapiens
SCDVQDNCD

SEQ ID NO: 6680 - protein, 9 aa, Homo Sapiens
DQHVHCLQD

SEQ ID NO: 6681 - protein, 9 aa, Homo Sapiens
DLEDMSVMV

SEQ ID NO: 6682 - protein, 9 aa, Homo Sapiens
VMVLRTQGP

SEQ ID NO: 6683 - protein, 9 aa, Homo Sapiens
VFHICGPED

SEQ ID NO: 6684 - protein, 9 aa, Homo Sapiens
QDKVSYEVP

SEQ ID NO: 6685 - protein, 9 aa, Homo Sapiens
SYEVPRLHG

SEQ ID NO: 6686 - protein, 9 aa, Homo Sapiens
VPRLHGDEE

SEQ ID NO: 6687 - protein, 9 aa, Homo Sapiens
HGDEERFFV

SEQ ID NO: 6688 - protein, 9 aa, Homo Sapiens
DEERFFVEG

SEQ ID NO: 6689 - protein, 9 aa, Homo Sapiens
EGLSFPDAG

SEQ ID NO: 6690 - protein, 9 aa, Homo Sapiens
SFHVTLLDD

SEQ ID NO: 6691 - protein, 9 aa, Homo Sapiens
DSNEDFSAS

SEQ ID NO: 6692 - protein, 9 aa, Homo Sapiens
DFSASPIFT

SEQ ID NO: 6693 - protein, 9 aa, Homo Sapiens
ASPIFTDTV

SEQ ID NO: 6694 - protein, 9 aa, Homo Sapiens
TDTVVFRVA

SEQ ID NO: 6695 - protein, 9 aa, Homo Sapiens
DTVVFRVAP

SEQ ID NO: 6696 - protein, 9 aa, Homo Sapiens
TPSTLPPLE

SEQ ID NO: 6697 - protein, 9 aa, Homo Sapiens
FVDAVAELA

SEQ ID NO: 6698 - protein, 9 aa, Homo Sapiens
KLTICPQAE

SEQ ID NO: 6699 - protein, 9 aa, Homo Sapiens
QDEMELGYV

SEQ ID NO: 6700 - protein, 9 aa, Homo Sapiens
QAPHKTLPV

SEQ ID NO: 6701 - protein, 9 aa, Homo Sapiens
TLPVVFDSP

SEQ ID NO: 6702 - protein, 9 aa, Homo Sapiens
VFDSPRNGE

SEQ ID NO: 6703 - protein, 9 aa, Homo Sapiens
DFPYKRILG

SEQ ID NO: 6704 - protein, 9 aa, Homo Sapiens
PYKRILGPD

SEQ ID NO: 6705 - protein, 9 aa, Homo Sapiens
ILGPDFGYV

SEQ ID NO: 6706 - protein, 9 aa, Homo Sapiens
LGPDFGYVT

SEQ ID NO: 6707 - protein, 9 aa, Homo Sapiens
DFGYVTREP

SEQ ID NO: 6708 - protein, 9 aa, Homo Sapiens
VSGLDSFGN

SEQ ID NO: 6709 - protein, 9 aa, Homo Sapiens
SGRRVTQVV

SEQ ID NO: 6710 - protein, 9 aa, Homo Sapiens
QVVRDFLHA

SEQ ID NO: 6711 - protein, 9 aa, Homo Sapiens
VDWLAVGHV

SEQ ID NO: 6712 - protein, 9 aa, Homo Sapiens
FLSFVPAPD

SEQ ID NO: 6713 - protein, 9 aa, Homo Sapiens
PGACFKLFQ

SEQ ID NO: 6714 - protein, 9 aa, Homo Sapiens
LINYNKFVQ

SEQ ID NO: 6715 - protein, 9 aa, Homo Sapiens
VLKRELGLA

SEQ ID NO: 6716 - protein, 9 aa, Homo Sapiens
FKTERKKAT

SEQ ID NO: 6717 - protein, 9 aa, Homo Sapiens
KKATAFFPD

SEQ ID NO: 6718 - protein, 9 aa, Homo Sapiens
FGPIINGCC

SEQ ID NO: 6719 - protein, 9 aa, Homo Sapiens
EEKVRSLLE

SEQ ID NO: 6720 - protein, 9 aa, Homo Sapiens
LGLHCTFID

SEQ ID NO: 6721 - protein, 9 aa, Homo Sapiens
HCTFIDDFT

SEQ ID NO: 6722 - protein, 9 aa, Homo Sapiens
PYHMLHGEV

SEQ ID NO: 6723 - protein, 9 aa, Homo Sapiens
LHGEVHCGT

SEQ ID NO: 6724 - protein, 9 aa, Homo Sapiens
ADTRRWRFD

SEQ ID NO: 6725 - protein, 9 aa, Homo Sapiens
LNDSHVQIS

SEQ ID NO: 6726 - protein, 9 aa, Homo Sapiens
YHSSHEPLP

SEQ ID NO: 6727 - protein, 9 aa, Homo Sapiens
DISLDCDLN

SEQ ID NO: 6728 - protein, 9 aa, Homo Sapiens
VDKRQWVWG

SEQ ID NO: 6729 - protein, 9 aa, Homo Sapiens
VNCDRDDPS

SEQ ID NO: 6730 - protein, 9 aa, Homo Sapiens
CDRDDPSCD

SEQ ID NO: 6731 - protein, 9 aa, Homo Sapiens
DPSCDVQDN

SEQ ID NO: 6732 - protein, 9 aa, Homo Sapiens
VQDNCDQHV

SEQ ID NO: 6733 - protein, 9 aa, Homo Sapiens
DNCDQHVHC

SEQ ID NO: 6734 - protein, 9 aa, Homo Sapiens
CDQHVHCLQ

SEQ ID NO: 6735 - protein, 9 aa, Homo Sapiens
CLQDLEDMS

SEQ ID NO: 6736 - protein, 9 aa, Homo Sapiens
VLRTQGPAA

SEQ ID NO: 6737 - protein, 9 aa, Homo Sapiens
QGPAALFDD

SEQ ID NO: 6738 - protein, 9 aa, Homo Sapiens
DVCEAYRHV

SEQ ID NO: 6739 - protein, 9 aa, Homo Sapiens
CEAYRHVLG

SEQ ID NO: 6740 - protein, 9 aa, Homo Sapiens
EVPRLHGDE

SEQ ID NO: 6741 - protein, 9 aa, Homo Sapiens
SFPDAGFTG

SEQ ID NO: 6742 - protein, 9 aa, Homo Sapiens
DAGFTGLIS

SEQ ID NO: 6743 - protein, 9 aa, Homo Sapiens
NNTCFVDAV

SEQ ID NO: 6744 - protein, 9 aa, Homo Sapiens
VAELARKAG

SEQ ID NO: 6745 - protein, 9 aa, Homo Sapiens
ENRNDRWIQ

SEQ ID NO: 6746 - protein, 9 aa, Homo Sapiens
WIQDEMELG

SEQ ID NO: 6747 - protein, 9 aa, Homo Sapiens
VVRDFLHAQ

SEQ ID NO: 6748 - protein, 9 aa, Homo Sapiens
ATAFFPDLV

SEQ ID NO: 6749 - protein, 9 aa, Homo Sapiens
FTPYHMLHG

SEQ ID NO: 6750 - protein, 9 aa, Homo Sapiens
HGEVHCGTN

SEQ ID NO: 6751 - protein, 9 aa, Homo Sapiens
APLEVYVCR

SEQ ID NO: 6752 - protein, 9 aa, Homo Sapiens
STLAPLEVY

SEQ ID NO: 6753 - protein, 9 aa, Homo Sapiens
MTPSTLAPL

SEQ ID NO: 6754 - protein, 9 aa, Homo Sapiens
LAPLEVYVC

SEQ ID NO: 6755 - protein, 9 aa, Homo Sapiens
WIMTPSTLA

SEQ ID NO: 6756 - protein, 9 aa, Homo Sapiens
IMTPSTLAP

SEQ ID NO: 6757 - protein, 9 aa, Homo Sapiens
TPSTLAPLE

SEQ ID NO: 6758 - protein, 9 aa, Homo Sapiens
PSTLAPLEV

SEQ ID NO: 6759 - protein, 9 aa, Homo Sapiens
TLAPLEVYV

SEQ ID NO: 6760 - protein, 9 aa, Homo Sapiens
SFVPVPDGK

SEQ ID NO: 6761 - protein, 9 aa, Homo Sapiens
PVPDGKGFR

SEQ ID NO: 6762 - protein, 9 aa, Homo Sapiens
VPDGKGFRM

SEQ ID NO: 6763 - protein, 9 aa, Homo Sapiens
VPVPDGKGF

SEQ ID NO: 6764 - protein, 9 aa, Homo Sapiens
DEFLSFVPV

SEQ ID NO: 6765 - protein, 9 aa, Homo Sapiens
LSFVPVPDG

SEQ ID NO: 6766 - protein, 9 aa, Homo Sapiens
EFLSFVPVP

SEQ ID NO: 6767 - protein, 9 aa, Homo Sapiens
FVPVPDGKG

SEQ ID NO: 6768 - protein, 9 aa, Homo Sapiens
FLSFVPVPD

SEQ ID NO: 6769 - protein, 9 aa, Homo Sapiens
GRILIGGNL

SEQ ID NO: 6770 - protein, 9 aa, Homo Sapiens
RRWRFDATL

SEQ ID NO: 6771 - protein, 9 aa, Homo Sapiens
WRFDATLEI

SEQ ID NO: 6772 - protein, 9 aa, Homo Sapiens
LRTQGPAAL

SEQ ID NO: 6773 - protein, 9 aa, Homo Sapiens
PRDRSVSGL

SEQ ID NO: 6774 - protein, 9 aa, Homo Sapiens
GRALLFQGV

SEQ ID NO: 6775 - protein, 9 aa, Homo Sapiens
NREVLKREL

SEQ ID NO: 6776 - protein, 9 aa, Homo Sapiens
CRVRNNTCF

SEQ ID NO: 6777 - protein, 9 aa, Homo Sapiens
TREPRDRSV

SEQ ID NO: 6778 - protein, 9 aa, Homo Sapiens
DRDDPSCDV

SEQ ID NO: 6779 - protein, 9 aa, Homo Sapiens
PRNGELQDF

SEQ ID NO: 6780 - protein, 9 aa, Homo Sapiens
RRVTQVVRD

SEQ ID NO: 6781 - protein, 9 aa, Homo Sapiens
ERKKATAFF

SEQ ID NO: 6782 - protein, 9 aa, Homo Sapiens
RSLLEPLGL

SEQ ID NO: 6783 - protein, 9 aa, Homo Sapiens
GLISFHVTL

SEQ ID NO: 6784 - protein, 9 aa, Homo Sapiens
RWIQDEMEL

SEQ ID NO: 6785 - protein, 9 aa, Homo Sapiens
KVSYEVPRL

SEQ ID NO: 6786 - protein, 9 aa, Homo Sapiens
RFFVEGLSF

SEQ ID NO: 6787 - protein, 9 aa, Homo Sapiens
KEYPLGRIL

SEQ ID NO: 6788 - protein, 9 aa, Homo Sapiens
RDFLHAQKV

SEQ ID NO: 6789 - protein, 9 aa, Homo Sapiens
KTISINQVL

SEQ ID NO: 6790 - protein, 9 aa, Homo Sapiens
AFFPDLVNM

SEQ ID NO: 6791 - protein, 9 aa, Homo Sapiens
GRERADTRR

SEQ ID NO: 6792 - protein, 9 aa, Homo Sapiens
AALFDDHKL

SEQ ID NO: 6793 - protein, 9 aa, Homo Sapiens
RLHGDEERF

SEQ ID NO: 6794 - protein, 9 aa, Homo Sapiens
RSVSGLDSF

SEQ ID NO: 6795 - protein, 9 aa, Homo Sapiens
GNLEVSPPV

SEQ ID NO: 6796 - protein, 9 aa, Homo Sapiens
GRRVTQVVR

SEQ ID NO: 6797 - protein, 9 aa, Homo Sapiens
RVTQVVRDF

SEQ ID NO: 6798 - protein, 9 aa, Homo Sapiens
RALLFQGVV

SEQ ID NO: 6799 - protein, 9 aa, Homo Sapiens
CDIIDIPQL

SEQ ID NO: 6800 - protein, 9 aa, Homo Sapiens
KATAFFPDL

SEQ ID NO: 6801 - protein, 9 aa, Homo Sapiens
GSVPEGTEM

SEQ ID NO: 6802 - protein, 9 aa, Homo Sapiens
RADTRRWRF

SEQ ID NO: 6803 - protein, 9 aa, Homo Sapiens
ATLEIIVVM

SEQ ID NO: 6804 - protein, 9 aa, Homo Sapiens
EPLPLAYAV

SEQ ID NO: 6805 - protein, 9 aa, Homo Sapiens
GRQDRNFVD

SEQ ID NO: 6806 - protein, 9 aa, Homo Sapiens
GPSGYGGIL

SEQ ID NO: 6807 - protein, 9 aa, Homo Sapiens
RTQGPAALF

SEQ ID NO: 6808 - protein, 9 aa, Homo Sapiens
RHVLGQDKV

SEQ ID NO: 6809 - protein, 9 aa, Homo Sapiens
RKAGCKLTI

SEQ ID NO: 6810 - protein, 9 aa, Homo Sapiens
QDFPYKRIL

SEQ ID NO: 6811 - protein, 9 aa, Homo Sapiens
KRILGPDFG

SEQ ID NO: 6812 - protein, 9 aa, Homo Sapiens
SGLDSFGNL

SEQ ID NO: 6813 - protein, 9 aa, Homo Sapiens
GHVDEFLSF

SEQ ID NO: 6814 - protein, 9 aa, Homo Sapiens
EVLKRELGL

SEQ ID NO: 6815 - protein, 9 aa, Homo Sapiens
PDLVNMLVL

SEQ ID NO: 6816 - protein, 9 aa, Homo Sapiens
KHLGIPKPF

SEQ ID NO: 6817 - protein, 9 aa, Homo Sapiens
KVRSLLEPL

SEQ ID NO: 6818 - protein, 9 aa, Homo Sapiens
GEVHCGTNV

SEQ ID NO: 6819 - protein, 9 aa, Homo Sapiens
MSLQRIVRV

SEQ ID NO: 6820 - protein, 9 aa, Homo Sapiens
QRIVRVSLE

SEQ ID NO: 6821 - protein, 9 aa, Homo Sapiens
VRVSLEHPT

SEQ ID NO: 6822 - protein, 9 aa, Homo Sapiens
VCVAGVETL

SEQ ID NO: 6823 - protein, 9 aa, Homo Sapiens
VDIYISPNM

SEQ ID NO: 6824 - protein, 9 aa, Homo Sapiens
RFDATLEII

SEQ ID NO: 6825 - protein, 9 aa, Homo Sapiens
PLAYAVLYL

SEQ ID NO: 6826 - protein, 9 aa, Homo Sapiens
VDISLDCDL

SEQ ID NO: 6827 - protein, 9 aa, Homo Sapiens
KRQWVWGPS

SEQ ID NO: 6828 - protein, 9 aa, Homo Sapiens
ALFDDHKLV

SEQ ID NO: 6829 - protein, 9 aa, Homo Sapiens
KRAQVFHIC

SEQ ID NO: 6830 - protein, 9 aa, Homo Sapiens
GQDKVSYEV

SEQ ID NO: 6831 - protein, 9 aa, Homo Sapiens
PRLHGDEER

SEQ ID NO: 6832 - protein, 9 aa, Homo Sapiens
ERFFVEGLS

SEQ ID NO: 6833 - protein, 9 aa, Homo Sapiens
EDFSASPIF

SEQ ID NO: 6834 - protein, 9 aa, Homo Sapiens
PIFTDTVVF

SEQ ID NO: 6835 - protein, 9 aa, Homo Sapiens
VVFRVAPWI

SEQ ID NO: 6836 - protein, 9 aa, Homo Sapiens
MTPSTLPPL

SEQ ID NO: 6837 - protein, 9 aa, Homo Sapiens
RVRNNTCFV

SEQ ID NO: 6838 - protein, 9 aa, Homo Sapiens
CFVDAVAEL

SEQ ID NO: 6839 - protein, 9 aa, Homo Sapiens
GKEYPLGRI

SEQ ID NO: 6840 - protein, 9 aa, Homo Sapiens
QKVQPPVEL

SEQ ID NO: 6841 - protein, 9 aa, Homo Sapiens
KVQPPVELF

SEQ ID NO: 6842 - protein, 9 aa, Homo Sapiens
ELFVDWLAV

SEQ ID NO: 6843 - protein, 9 aa, Homo Sapiens
KCGHGRALL

SEQ ID NO: 6844 - protein, 9 aa, Homo Sapiens
KDLINYNKF

SEQ ID NO: 6845 - protein, 9 aa, Homo Sapiens
KRELGLAEC

SEQ ID NO: 6846 - protein, 9 aa, Homo Sapiens
NMLVLGKHL

SEQ ID NO: 6847 - protein, 9 aa, Homo Sapiens
DDFTPYHML

SEQ ID NO: 6848 - protein, 9 aa, Homo Sapiens
LQRIVRVSL

SEQ ID NO: 6849 - protein, 9 aa, Homo Sapiens
AGVETLVDI

SEQ ID NO: 6850 - protein, 9 aa, Homo Sapiens
GTPGVDIYI

SEQ ID NO: 6851 - protein, 9 aa, Homo Sapiens
VMNSPSNDL

SEQ ID NO: 6852 - protein, 9 aa, Homo Sapiens
SYHSSHEPL

SEQ ID NO: 6853 - protein, 9 aa, Homo Sapiens
HSSHEPLPL

SEQ ID NO: 6854 - protein, 9 aa, Homo Sapiens
VLYLTCVDI

SEQ ID NO: 6855 - protein, 9 aa, Homo Sapiens
YLTCVDISL

SEQ ID NO: 6856 - protein, 9 aa, Homo Sapiens
DRNFVDKRQ

SEQ ID NO: 6857 - protein, 9 aa, Homo Sapiens
SGYGGILLV

SEQ ID NO: 6858 - protein, 9 aa, Homo Sapiens
NCDQHVHCL

SEQ ID NO: 6859 - protein, 9 aa, Homo Sapiens
QHVHCLQDL

SEQ ID NO: 6860 - protein, 9 aa, Homo Sapiens
HCLQDLEDM

SEQ ID NO: 6861 - protein, 9 aa, Homo Sapiens
QDLEDMSVM

SEQ ID NO: 6862 - protein, 9 aa, Homo Sapiens
LEDMSVMVL

SEQ ID NO: 6863 - protein, 9 aa, Homo Sapiens
LFDDHKLVL

SEQ ID NO: 6864 - protein, 9 aa, Homo Sapiens
EERFFVEGL

SEQ ID NO: 6865 - protein, 9 aa, Homo Sapiens
GLSFPDAGF

SEQ ID NO: 6866 - protein, 9 aa, Homo Sapiens
AGFTGLISF

SEQ ID NO: 6867 - protein, 9 aa, Homo Sapiens
LISFHVTLL

SEQ ID NO: 6868 - protein, 9 aa, Homo Sapiens
FRVAPWIMT

SEQ ID NO: 6869 - protein, 9 aa, Homo Sapiens
PWIMTPSTL

SEQ ID NO: 6870 - protein, 9 aa, Homo Sapiens
ARKAGCKLT

SEQ ID NO: 6871 - protein, 9 aa, Homo Sapiens
NRNDRWIQD

SEQ ID NO: 6872 - protein, 9 aa, Homo Sapiens
FDSPRNGEL

SEQ ID NO: 6873 - protein, 9 aa, Homo Sapiens
ILGPDFGYV

SEQ ID NO: 6874 - protein, 9 aa, Homo Sapiens
DRSVSGLDS

SEQ ID NO: 6875 - protein, 9 aa, Homo Sapiens
VANGKEYPL

SEQ ID NO: 6876 - protein, 9 aa, Homo Sapiens
VRDFLHAQK

SEQ ID NO: 6877 - protein, 9 aa, Homo Sapiens
PVELFVDWL

SEQ ID NO: 6878 - protein, 9 aa, Homo Sapiens
AVGHVDEFL

SEQ ID NO: 6879 - protein, 9 aa, Homo Sapiens
FRMLLASPG

SEQ ID NO: 6880 - protein, 9 aa, Homo Sapiens
ASPGACFKL

SEQ ID NO: 6881 - protein, 9 aa, Homo Sapiens
QGVVDDEQV

SEQ ID NO: 6882 - protein, 9 aa, Homo Sapiens
NQVLSNKDL

SEQ ID NO: 6883 - protein, 9 aa, Homo Sapiens
QVLSNKDLI

SEQ ID NO: 6884 - protein, 9 aa, Homo Sapiens
FFPDLVNML

SEQ ID NO: 6885 - protein, 9 aa, Homo Sapiens
LVLGKHLGI

SEQ ID NO: 6886 - protein, 9 aa, Homo Sapiens
GIPKPFGPI

SEQ ID NO: 6887 - protein, 9 aa, Homo Sapiens
IPKPFGPII

SEQ ID NO: 6888 - protein, 9 aa, Homo Sapiens
PIINGCCCL

SEQ ID NO: 6889 - protein, 9 aa, Homo Sapiens
GCCCLEEKV

SEQ ID NO: 6890 - protein, 9 aa, Homo Sapiens
CLEEKVRSL

SEQ ID NO: 6891 - protein, 9 aa, Homo Sapiens
VRSLLEPLG

SEQ ID NO: 6892 - protein, 9 aa, Homo Sapiens
GTNVCRKPF

SEQ ID NO: 6893 - protein, 9 aa, Homo Sapiens
CRKPFSFKW

SEQ ID NO: 6894 - protein, 9 aa, Homo Sapiens
EHPTSAVCV

SEQ ID NO: 6895 - protein, 9 aa, Homo Sapiens
TLVDIYGSV

SEQ ID NO: 6896 - protein, 9 aa, Homo Sapiens
FEVYGTPGV

SEQ ID NO: 6897 - protein, 9 aa, Homo Sapiens
ERGRERADT

SEQ ID NO: 6898 - protein, 9 aa, Homo Sapiens
ERADTRRWR

SEQ ID NO: 6899 - protein, 9 aa, Homo Sapiens
TRRWRFDAT

SEQ ID NO: 6900 - protein, 9 aa, Homo Sapiens
DLNDSHVQI

SEQ ID NO: 6901 - protein, 9 aa, Homo Sapiens
PLPLAYAVL

SEQ ID NO: 6902 - protein, 9 aa, Homo Sapiens
PSGYGGILL

SEQ ID NO: 6903 - protein, 9 aa, Homo Sapiens
AKRAQVFHI

SEQ ID NO: 6904 - protein, 9 aa, Homo Sapiens
VCEAYRHVL

SEQ ID NO: 6905 - protein, 9 aa, Homo Sapiens
YRHVLGQDK

SEQ ID NO: 6906 - protein, 9 aa, Homo Sapiens
FPDAGFTGL

SEQ ID NO: 6907 - protein, 9 aa, Homo Sapiens
FTDTVVFRV

SEQ ID NO: 6908 - protein, 9 aa, Homo Sapiens
PSTLPPLEV

SEQ ID NO: 6909 - protein, 9 aa, Homo Sapiens
TLPPLEVYV

SEQ ID NO: 6910 - protein, 9 aa, Homo Sapiens
PLEVYVCRV

SEQ ID NO: 6911 - protein, 9 aa, Homo Sapiens
VRNNTCFVD

SEQ ID NO: 6912 - protein, 9 aa, Homo Sapiens
NNTCFVDAV

SEQ ID NO: 6913 - protein, 9 aa, Homo Sapiens
LARKAGCKL

SEQ ID NO: 6914 - protein, 9 aa, Homo Sapiens
DRWIQDEME

SEQ ID NO: 6915 - protein, 9 aa, Homo Sapiens
YVQAPHKTL

SEQ ID NO: 6916 - protein, 9 aa, Homo Sapiens
APHKTLPVV

SEQ ID NO: 6917 - protein, 9 aa, Homo Sapiens
LPGSSGRRV

SEQ ID NO: 6918 - protein, 9 aa, Homo Sapiens
SSGRRVTQV

SEQ ID NO: 6919 - protein, 9 aa, Homo Sapiens
VTQVVRDFL

SEQ ID NO: 6920 - protein, 9 aa, Homo Sapiens
VQPPVELFV

SEQ ID NO: 6921 - protein, 9 aa, Homo Sapiens
LAVGHVDEF

SEQ ID NO: 6922 - protein, 9 aa, Homo Sapiens
VPAPDGKGF

SEQ ID NO: 6923 - protein, 9 aa, Homo Sapiens
APDGKGFRM

SEQ ID NO: 6924 - protein, 9 aa, Homo Sapiens
PDGKGFRML

SEQ ID NO: 6925 - protein, 9 aa, Homo Sapiens
DGKGFRMLL

SEQ ID NO: 6926 - protein, 9 aa, Homo Sapiens
QKCGHGRAL

SEQ ID NO: 6927 - protein, 9 aa, Homo Sapiens
CGHGRALLF

SEQ ID NO: 6928 - protein, 9 aa, Homo Sapiens
VKTISINQV

SEQ ID NO: 6929 - protein, 9 aa, Homo Sapiens
CIDWNREVL

SEQ ID NO: 6930 - protein, 9 aa, Homo Sapiens
LGLAECDII

SEQ ID NO: 6931 - protein, 9 aa, Homo Sapiens
DIIDIPQLF

SEQ ID NO: 6932 - protein, 9 aa, Homo Sapiens
LEEKVRSLL

SEQ ID NO: 6933 - protein, 9 aa, Homo Sapiens
EPLGLHCTF

SEQ ID NO: 6934 - protein, 9 aa, Homo Sapiens
IDDFTPYHM

SEQ ID NO: 6935 - protein, 9 aa, Homo Sapiens
FSFKWWNMV

SEQ ID NO: 6936 - protein, 9 aa, Homo Sapiens
TSAVCVAGV

SEQ ID NO: 6937 - protein, 9 aa, Homo Sapiens
VYGTPGVDI

SEQ ID NO: 6938 - protein, 9 aa, Homo Sapiens
DATLEIIVV

SEQ ID NO: 6939 - protein, 9 aa, Homo Sapiens
YAVLYLTCV

SEQ ID NO: 6940 - protein, 9 aa, Homo Sapiens
CEGRQDRNF

SEQ ID NO: 6941 - protein, 9 aa, Homo Sapiens
EGRQDRNFV

SEQ ID NO: 6942 - protein, 9 aa, Homo Sapiens
NFVDKRQWV

SEQ ID NO: 6943 - protein, 9 aa, Homo Sapiens
WGPSGYGGI

SEQ ID NO: 6944 - protein, 9 aa, Homo Sapiens
DLEDMSVMV

SEQ ID NO: 6945 - protein, 9 aa, Homo Sapiens
SYDAKRAQV

SEQ ID NO: 6946 - protein, 9 aa, Homo Sapiens
YDAKRAQVF

SEQ ID NO: 6947 - protein, 9 aa, Homo Sapiens
FHICGPEDV

SEQ ID NO: 6948 - protein, 9 aa, Homo Sapiens
FTGLISFHV

SEQ ID NO: 6949 - protein, 9 aa, Homo Sapiens
NEDFSASPI

SEQ ID NO: 6950 - protein, 9 aa, Homo Sapiens
ASPIFTDTV

SEQ ID NO: 6951 - protein, 9 aa, Homo Sapiens
SPIFTDTVV

SEQ ID NO: 6952 - protein, 9 aa, Homo Sapiens
AENRNDRWI

SEQ ID NO: 6953 - protein, 9 aa, Homo Sapiens
NDRWIQDEM

SEQ ID NO: 6954 - protein, 9 aa, Homo Sapiens
QAPHKTLPV

SEQ ID NO: 6955 - protein, 9 aa, Homo Sapiens
PHKTLPVVF

SEQ ID NO: 6956 - protein, 9 aa, Homo Sapiens
LQDFPYKRI

SEQ ID NO: 6957 - protein, 9 aa, Homo Sapiens
YKRILGPDF

SEQ ID NO: 6958 - protein, 9 aa, Homo Sapiens
LDSFGNLEV

SEQ ID NO: 6959 - protein, 9 aa, Homo Sapiens
NLEVSPPVV

SEQ ID NO: 6960 - protein, 9 aa, Homo Sapiens
HAQKVQPPV

SEQ ID NO: 6961 - protein, 9 aa, Homo Sapiens
VDWLAVGHV

SEQ ID NO: 6962 - protein, 9 aa, Homo Sapiens
LLASPGACF

SEQ ID NO: 6963 - protein, 9 aa, Homo Sapiens
VDDEQVKTI

SEQ ID NO: 6964 - protein, 9 aa, Homo Sapiens
DLINYNKFV

SEQ ID NO: 6965 - protein, 9 aa, Homo Sapiens
SCIDWNREV

SEQ ID NO: 6966 - protein, 9 aa, Homo Sapiens
LAECDIIDI

SEQ ID NO: 6967 - protein, 9 aa, Homo Sapiens
TERKKATAF

SEQ ID NO: 6968 - protein, 9 aa, Homo Sapiens
ATAFFPDLV

SEQ ID NO: 6969 - protein, 9 aa, Homo Sapiens
PFSFKWWNM

SEQ ID NO: 6970 - protein, 9 aa, Homo Sapiens
SLEHPTSAV

SEQ ID NO: 6971 - protein, 9 aa, Homo Sapiens
CVAGVETLV

SEQ ID NO: 6972 - protein, 9 aa, Homo Sapiens
SVPEGTEMF

SEQ ID NO: 6973 - protein, 9 aa, Homo Sapiens
PEGTEMFEV

SEQ ID NO: 6974 - protein, 9 aa, Homo Sapiens
FDATLEIIV

SEQ ID NO: 6975 - protein, 9 aa, Homo Sapiens
SNDLNDSHV

SEQ ID NO: 6976 - protein, 9 aa, Homo Sapiens
RNFVDKRQW

SEQ ID NO: 6977 - protein, 9 aa, Homo Sapiens
VQDNCDQHV

SEQ ID NO: 6978 - protein, 9 aa, Homo Sapiens
LQDLEDMSV

SEQ ID NO: 6979 - protein, 9 aa, Homo Sapiens
DVCEAYRHV

SEQ ID NO: 6980 - protein, 9 aa, Homo Sapiens
LHGDEERFF

SEQ ID NO: 6981 - protein, 9 aa, Homo Sapiens
HGDEERFFV

SEQ ID NO: 6982 - protein, 9 aa, Homo Sapiens
PDAGFTGLI

SEQ ID NO: 6983 - protein, 9 aa, Homo Sapiens
LLDDSNEDF

SEQ ID NO: 6984 - protein, 9 aa, Homo Sapiens
VFRVAPWIM

SEQ ID NO: 6985 - protein, 9 aa, Homo Sapiens
QDEMELGYV

SEQ ID NO: 6986 - protein, 9 aa, Homo Sapiens
EYPLGRILI

SEQ ID NO: 6987 - protein, 9 aa, Homo Sapiens
SGRRVTQVV

SEQ ID NO: 6988 - protein, 9 aa, Homo Sapiens
HVDEFLSFV

SEQ ID NO: 6989 - protein, 9 aa, Homo Sapiens
SPGACFKLF

SEQ ID NO: 6990 - protein, 9 aa, Homo Sapiens
DEQVKTISI

SEQ ID NO: 6991 - protein, 9 aa, Homo Sapiens
YNKFVQSCI

SEQ ID NO: 6992 - protein, 9 aa, Homo Sapiens
ELGLAECDI

SEQ ID NO: 6993 - protein, 9 aa, Homo Sapiens
FPDLVNMLV

SEQ ID NO: 6994 - protein, 9 aa, Homo Sapiens
PLGLHCTFI

SEQ ID NO: 6995 - protein, 9 aa, Homo Sapiens
LHCTFIDDF

SEQ ID NO: 6996 - protein, 9 aa, Homo Sapiens
PYHMLHGEV

SEQ ID NO: 6997 - protein, 9 aa, Homo Sapiens
NVCRKPFSF

SEQ ID NO: 6998 - protein, 9 aa, Homo Sapiens
GELQDFPYK

SEQ ID NO: 6999 - protein, 9 aa, Homo Sapiens
RMLLASPGA

SEQ ID NO: 7000 - protein, 9 aa, Homo Sapiens
RELGLAECD

SEQ ID NO: 7001 - protein, 9 aa, Homo Sapiens
RIVRVSLEH

SEQ ID NO: 7002 - protein, 9 aa, Homo Sapiens
RERADTRRW

SEQ ID NO: 7003 - protein, 9 aa, Homo Sapiens
RWRFDATLE

SEQ ID NO: 7004 - protein, 9 aa, Homo Sapiens
KTLPVVFDS

SEQ ID NO: 7005 - protein, 9 aa, Homo Sapiens
RILGPDFGY

SEQ ID NO: 7006 - protein, 9 aa, Homo Sapiens
GYVTREPRD

SEQ ID NO: 7007 - protein, 9 aa, Homo Sapiens
RILIGGNLP

SEQ ID NO: 7008 - protein, 9 aa, Homo Sapiens
GNLPGSSGR

SEQ ID NO: 7009 - protein, 9 aa, Homo Sapiens
RVSLEHPTS

SEQ ID NO: 7010 - protein, 9 aa, Homo Sapiens
RGRERADTR

SEQ ID NO: 7011 - protein, 9 aa, Homo Sapiens
ISLDCDLNC

SEQ ID NO: 7012 - protein, 9 aa, Homo Sapiens
RQDRNFVDK

SEQ ID NO: 7013 - protein, 9 aa, Homo Sapiens
RQWVWGPSG

SEQ ID NO: 7014 - protein, 9 aa, Homo Sapiens
GYGGILLVN

SEQ ID NO: 7015 - protein, 9 aa, Homo Sapiens
GGILLVNCD

SEQ ID NO: 7016 - protein, 9 aa, Homo Sapiens
GILLVNCDR

SEQ ID NO: 7017 - protein, 9 aa, Homo Sapiens
RDDPSCDVQ

SEQ ID NO: 7018 - protein, 9 aa, Homo Sapiens
LSFPDAGFT

SEQ ID NO: 7019 - protein, 9 aa, Homo Sapiens
RVAPWIMTP

SEQ ID NO: 7020 - protein, 9 aa, Homo Sapiens
RNNTCFVDA

SEQ ID NO: 7021 - protein, 9 aa, Homo Sapiens
TCFVDAVAE

SEQ ID NO: 7022 - protein, 9 aa, Homo Sapiens
CKLTICPQA

SEQ ID NO: 7023 - protein, 9 aa, Homo Sapiens
REPRDRSVS

SEQ ID NO: 7024 - protein, 9 aa, Homo Sapiens
RDRSVSGLD

SEQ ID NO: 7025 - protein, 9 aa, Homo Sapiens
EFLSFVPAP

SEQ ID NO: 7026 - protein, 9 aa, Homo Sapiens
KGFRMLLAS

SEQ ID NO: 7027 - protein, 9 aa, Homo Sapiens
GVVDDEQVK

SEQ ID NO: 7028 - protein, 9 aa, Homo Sapiens
INYNKFVQS

SEQ ID NO: 7029 - protein, 9 aa, Homo Sapiens
REVLKRELG

SEQ ID NO: 7030 - protein, 9 aa, Homo Sapiens
RKKATAFFP

SEQ ID NO: 7031 - protein, 9 aa, Homo Sapiens
KPFGPIING

SEQ ID NO: 7032 - protein, 9 aa, Homo Sapiens
KPFSFKWWN

SEQ ID NO: 7033 - protein, 9 aa, Homo Sapiens
GVETLVDIY

SEQ ID NO: 7034 - protein, 9 aa, Homo Sapiens
ETLVDIYGS

SEQ ID NO: 7035 - protein, 9 aa, Homo Sapiens
DIYGSVPEG

SEQ ID NO: 7036 - protein, 9 aa, Homo Sapiens
GTEMFEVYG

SEQ ID NO: 7037 - protein, 9 aa, Homo Sapiens
LPLAYAVLY

SEQ ID NO: 7038 - protein, 9 aa, Homo Sapiens
ILLVNCDRD

SEQ ID NO: 7039 - protein, 9 aa, Homo Sapiens
RAQVFHICG

SEQ ID NO: 7040 - protein, 9 aa, Homo Sapiens
EDVCEAYRH

SEQ ID NO: 7041 - protein, 9 aa, Homo Sapiens
EAYRHVLGQ

SEQ ID NO: 7042 - protein, 9 aa, Homo Sapiens
GFTGLISFH

SEQ ID NO: 7043 - protein, 9 aa, Homo Sapiens
ISFHVTLLD

SEQ ID NO: 7044 - protein, 9 aa, Homo Sapiens
VTLLDDSNE

SEQ ID NO: 7045 - protein, 9 aa, Homo Sapiens
IFTDTVVFR

SEQ ID NO: 7046 - protein, 9 aa, Homo Sapiens
IMTPSTLPP

SEQ ID NO: 7047 - protein, 9 aa, Homo Sapiens
EVYVCRVRN

SEQ ID NO: 7048 - protein, 9 aa, Homo Sapiens
RNDRWIQDE

SEQ ID NO: 7049 - protein, 9 aa, Homo Sapiens
LGYVQAPHK

SEQ ID NO: 7050 - protein, 9 aa, Homo Sapiens
GYVQAPHKT

SEQ ID NO: 7051 - protein, 9 aa, Homo Sapiens
PVVFDSPRN

SEQ ID NO: 7052 - protein, 9 aa, Homo Sapiens
RNGELQDFP

SEQ ID NO: 7053 - protein, 9 aa, Homo Sapiens
GPDFGYVTR

SEQ ID NO: 7054 - protein, 9 aa, Homo Sapiens
PDFGYVTRE

SEQ ID NO: 7055 - protein, 9 aa, Homo Sapiens
GLDSFGNLE

SEQ ID NO: 7056 - protein, 9 aa, Homo Sapiens
GSSGRRVTQ

SEQ ID NO: 7057 - protein, 9 aa, Homo Sapiens
LSFVPAPDG

SEQ ID NO: 7058 - protein, 9 aa, Homo Sapiens
GKGFRMLLA

SEQ ID NO: 7059 - protein, 9 aa, Homo Sapiens
GACFKLFQE

SEQ ID NO: 7060 - protein, 9 aa, Homo Sapiens
KLFQEKQKC

SEQ ID NO: 7061 - protein, 9 aa, Homo Sapiens
GHGRALLFQ

SEQ ID NO: 7062 - protein, 9 aa, Homo Sapiens
ALLFQGVVD

SEQ ID NO: 7063 - protein, 9 aa, Homo Sapiens
LLFQGVVDD

SEQ ID NO: 7064 - protein, 9 aa, Homo Sapiens
ISINQVLSN

SEQ ID NO: 7065 - protein, 9 aa, Homo Sapiens
GKHLGIPKP

SEQ ID NO: 7066 - protein, 9 aa, Homo Sapiens
GPIINGCCC

SEQ ID NO: 7067 - protein, 9 aa, Homo Sapiens
CCLEEKVRS

SEQ ID NO: 7068 - protein, 9 aa, Homo Sapiens
RKPFSFKWW

SEQ ID NO: 7069 - protein, 9 aa, Homo Sapiens
HPTSAVCVA

SEQ ID NO: 7070 - protein, 9 aa, Homo Sapiens
YGTPGVDIY

SEQ ID NO: 7071 - protein, 9 aa, Homo Sapiens
GVDIYISPN

SEQ ID NO: 7072 - protein, 9 aa, Homo Sapiens
IYISPNMER

SEQ ID NO: 7073 - protein, 9 aa, Homo Sapiens
TLEIIVVMN

SEQ ID NO: 7074 - protein, 9 aa, Homo Sapiens
LEIIVVMNS

SEQ ID NO: 7075 - protein, 9 aa, Homo Sapiens
IVVMNSPSN

SEQ ID NO: 7076 - protein, 9 aa, Homo Sapiens
NSPSNDLND

SEQ ID NO: 7077 - protein, 9 aa, Homo Sapiens
NDLNDSHVQ

SEQ ID NO: 7078 - protein, 9 aa, Homo Sapiens
SHVQISYHS

SEQ ID NO: 7079 - protein, 9 aa, Homo Sapiens
ISYHSSHEP

SEQ ID NO: 7080 - protein, 9 aa, Homo Sapiens
LAYAVLYLT

SEQ ID NO: 7081 - protein, 9 aa, Homo Sapiens
AVLYLTCVD

SEQ ID NO: 7082 - protein, 9 aa, Homo Sapiens
LYLTCVDIS

SEQ ID NO: 7083 - protein, 9 aa, Homo Sapiens
TCVDISLDC

SEQ ID NO: 7084 - protein, 9 aa, Homo Sapiens
CDLNCEGRQ

SEQ ID NO: 7085 - protein, 9 aa, Homo Sapiens
DDPSCDVQD

SEQ ID NO: 7086 - protein, 9 aa, Homo Sapiens
DMSVMVLRT

SEQ ID NO: 7087 - protein, 9 aa, Homo Sapiens
TQGPAALFD

SEQ ID NO: 7088 - protein, 9 aa, Homo Sapiens
GPAALFDDH

SEQ ID NO: 7089 - protein, 9 aa, Homo Sapiens
KLVLHTSSY

SEQ ID NO: 7090 - protein, 9 aa, Homo Sapiens
TSSYDAKRA

SEQ ID NO: 7091 - protein, 9 aa, Homo Sapiens
QVFHICGPE

SEQ ID NO: 7092 - protein, 9 aa, Homo Sapiens
ICGPEDVCE

SEQ ID NO: 7093 - protein, 9 aa, Homo Sapiens
GPEDVCEAY

SEQ ID NO: 7094 - protein, 9 aa, Homo Sapiens
DKVSYEVPR

SEQ ID NO: 7095 - protein, 9 aa, Homo Sapiens
GDEERFFVE

SEQ ID NO: 7096 - protein, 9 aa, Homo Sapiens
EGLSFPDAG

SEQ ID NO: 7097 - protein, 9 aa, Homo Sapiens
TLLDDSNED

SEQ ID NO: 7098 - protein, 9 aa, Homo Sapiens
STLPPLEVY

SEQ ID NO: 7099 - protein, 9 aa, Homo Sapiens
PPLEVYVCR

SEQ ID NO: 7100 - protein, 9 aa, Homo Sapiens
VYVCRVRNN

SEQ ID NO: 7101 - protein, 9 aa, Homo Sapiens
AELARKAGC

SEQ ID NO: 7102 - protein, 9 aa, Homo Sapiens
GCKLTICPQ

SEQ ID NO: 7103 - protein, 9 aa, Homo Sapiens
KLTICPQAE

SEQ ID NO: 7104 - protein, 9 aa, Homo Sapiens
TICPQAENR

SEQ ID NO: 7105 - protein, 9 aa, Homo Sapiens
MELGYVQAP

SEQ ID NO: 7106 - protein, 9 aa, Homo Sapiens
HKTLPVVFD

SEQ ID NO: 7107 - protein, 9 aa, Homo Sapiens
VVFDSPRNG

SEQ ID NO: 7108 - protein, 9 aa, Homo Sapiens
FPYKRILGP

SEQ ID NO: 7109 - protein, 9 aa, Homo Sapiens
LEVSPPVVA

SEQ ID NO: 7110 - protein, 9 aa, Homo Sapiens
EVSPPVVAN

SEQ ID NO: 7111 - protein, 9 aa, Homo Sapiens
VSPPVVANG

SEQ ID NO: 7112 - protein, 9 aa, Homo Sapiens
YPLGRILIG

SEQ ID NO: 7113 - protein, 9 aa, Homo Sapiens
ILIGGNLPG

SEQ ID NO: 7114 - protein, 9 aa, Homo Sapiens
GGNLPGSSG

SEQ ID NO: 7115 - protein, 9 aa, Homo Sapiens
QVVRDFLHA

SEQ ID NO: 7116 - protein, 9 aa, Homo Sapiens
DEFLSFVPA

SEQ ID NO: 7117 - protein, 9 aa, Homo Sapiens
GFRMLLASP

SEQ ID NO: 7118 - protein, 9 aa, Homo Sapiens
ACFKLFQEK

SEQ ID NO: 7119 - protein, 9 aa, Homo Sapiens
FKLFQEKQK

SEQ ID NO: 7120 - protein, 9 aa, Homo Sapiens
KQKCGHGRA

SEQ ID NO: 7121 - protein, 9 aa, Homo Sapiens
NKDLINYNK

SEQ ID NO: 7122 - protein, 9 aa, Homo Sapiens
KFVQSCIDW

SEQ ID NO: 7123 - protein, 9 aa, Homo Sapiens
GLAECDIID

SEQ ID NO: 7124 - protein, 9 aa, Homo Sapiens
IDIPQLFKT

SEQ ID NO: 7125 - protein, 9 aa, Homo Sapiens
PQLFKTERK

SEQ ID NO: 7126 - protein, 9 aa, Homo Sapiens
TAFFPDLVN

SEQ ID NO: 7127 - protein, 9 aa, Homo Sapiens
GLHCTFIDD

SEQ ID NO: 7128 - protein, 9 aa, Homo Sapiens
CTFIDDFTP

SEQ ID NO: 7129 - protein, 9 aa, Homo Sapiens
HMLHGEVHC

SEQ ID NO: 7130 - protein, 9 aa, Homo Sapiens
SLQRIVRVS

SEQ ID NO: 7131 - protein, 9 aa, Homo Sapiens
VSLEHPTSA

SEQ ID NO: 7132 - protein, 9 aa, Homo Sapiens
SAVCVAGVE

SEQ ID NO: 7133 - protein, 9 aa, Homo Sapiens
AVCVAGVET

SEQ ID NO: 7134 - protein, 9 aa, Homo Sapiens
VDIYGSVPE

SEQ ID NO: 7135 - protein, 9 aa, Homo Sapiens
IYGSVPEGT

SEQ ID NO: 7136 - protein, 9 aa, Homo Sapiens
TEMFEVYGT

SEQ ID NO: 7137 - protein, 9 aa, Homo Sapiens
EMFEVYGTP

SEQ ID NO: 7138 - protein, 9 aa, Homo Sapiens
EVYGTPGVD

SEQ ID NO: 7139 - protein, 9 aa, Homo Sapiens
TPGVDIYIS

SEQ ID NO: 7140 - protein, 9 aa, Homo Sapiens
PGVDIYISP

SEQ ID NO: 7141 - protein, 9 aa, Homo Sapiens
DIYISPNME

SEQ ID NO: 7142 - protein, 9 aa, Homo Sapiens
YISPNMERG

SEQ ID NO: 7143 - protein, 9 aa, Homo Sapiens
ADTRRWRFD

SEQ ID NO: 7144 - protein, 9 aa, Homo Sapiens
IIVVMNSPS

SEQ ID NO: 7145 - protein, 9 aa, Homo Sapiens
LNDSHVQIS

SEQ ID NO: 7146 - protein, 9 aa, Homo Sapiens
VQISYHSSH

SEQ ID NO: 7147 - protein, 9 aa, Homo Sapiens
YHSSHEPLP

SEQ ID NO: 7148 - protein, 9 aa, Homo Sapiens
SHEPLPLAY

SEQ ID NO: 7149 - protein, 9 aa, Homo Sapiens
AYAVLYLTC

SEQ ID NO: 7150 - protein, 9 aa, Homo Sapiens
VWGPSGYGG

SEQ ID NO: 7151 - protein, 9 aa, Homo Sapiens
YGGILLVNC

SEQ ID NO: 7152 - protein, 9 aa, Homo Sapiens
NCDRDDPSC

SEQ ID NO: 7153 - protein, 9 aa, Homo Sapiens
DPSCDVQDN

SEQ ID NO: 7154 - protein, 9 aa, Homo Sapiens
CDVQDNCDQ

SEQ ID NO: 7155 - protein, 9 aa, Homo Sapiens
DQHVHCLQD

SEQ ID NO: 7156 - protein, 9 aa, Homo Sapiens
EDMSVMVLR

SEQ ID NO: 7157 - protein, 9 aa, Homo Sapiens
MVLRTQGPA

SEQ ID NO: 7158 - protein, 9 aa, Homo Sapiens
DDHKLVLHT

SEQ ID NO: 7159 - protein, 9 aa, Homo Sapiens
HKLVLHTSS

SEQ ID NO: 7160 - protein, 9 aa, Homo Sapiens
LVLHTSSYD

SEQ ID NO: 7161 - protein, 9 aa, Homo Sapiens
LHTSSYDAK

SEQ ID NO: 7162 - protein, 9 aa, Homo Sapiens
SSYDAKRAQ

SEQ ID NO: 7163 - protein, 9 aa, Homo Sapiens
AQVFHICGP

SEQ ID NO: 7164 - protein, 9 aa, Homo Sapiens
CGPEDVCEA

SEQ ID NO: 7165 - protein, 9 aa, Homo Sapiens
AYRHVLGQD

SEQ ID NO: 7166 - protein, 9 aa, Homo Sapiens
HVLGQDKVS

SEQ ID NO: 7167 - protein, 9 aa, Homo Sapiens
VLGQDKVSY

SEQ ID NO: 7168 - protein, 9 aa, Homo Sapiens
VSYEVPRLH

SEQ ID NO: 7169 - protein, 9 aa, Homo Sapiens
YEVPRLHGD

SEQ ID NO: 7170 - protein, 9 aa, Homo Sapiens
TGLISFHVT

SEQ ID NO: 7171 - protein, 9 aa, Homo Sapiens
SASPIFTDT

SEQ ID NO: 7172 - protein, 9 aa, Homo Sapiens
DTVVFRVAP

SEQ ID NO: 7173 - protein, 9 aa, Homo Sapiens
TVVFRVAPW

SEQ ID NO: 7174 - protein, 9 aa, Homo Sapiens
APWIMTPST

SEQ ID NO: 7175 - protein, 9 aa, Homo Sapiens
LPPLEVYVC

SEQ ID NO: 7176 - protein, 9 aa, Homo Sapiens
DAVAELARK

SEQ ID NO: 7177 - protein, 9 aa, Homo Sapiens
AVAELARKA

SEQ ID NO: 7178 - protein, 9 aa, Homo Sapiens
KAGCKLTIC

SEQ ID NO: 7179 - protein, 9 aa, Homo Sapiens
ICPQAENRN

SEQ ID NO: 7180 - protein, 9 aa, Homo Sapiens
IQDEMELGY

SEQ ID NO: 7181 - protein, 9 aa, Homo Sapiens
EMELGYVQA

SEQ ID NO: 7182 - protein, 9 aa, Homo Sapiens
SPRNGELQD

SEQ ID NO: 7183 - protein, 9 aa, Homo Sapiens
FGYVTREPR

SEQ ID NO: 7184 - protein, 9 aa, Homo Sapiens
DSFGNLEVS

SEQ ID NO: 7185 - protein, 9 aa, Homo Sapiens
ANGKEYPLG

SEQ ID NO: 7186 - protein, 9 aa, Homo Sapiens
DFLHAQKVQ

SEQ ID NO: 7187 - protein, 9 aa, Homo Sapiens
FLHAQKVQP

SEQ ID NO: 7188 - protein, 9 aa, Homo Sapiens
AQKVQPPVE

SEQ ID NO: 7189 - protein, 9 aa, Homo Sapiens
PPVELFVDW

SEQ ID NO: 7190 - protein, 9 aa, Homo Sapiens
VELFVDWLA

SEQ ID NO: 7191 - protein, 9 aa, Homo Sapiens
FVDWLAVGH

SEQ ID NO: 7192 - protein, 9 aa, Homo Sapiens
DWLAVGHVD

SEQ ID NO: 7193 - protein, 9 aa, Homo Sapiens
SFVPAPDGK

SEQ ID NO: 7194 - protein, 9 aa, Homo Sapiens
MLLASPGAC

SEQ ID NO: 7195 - protein, 9 aa, Homo Sapiens
LASPGACFK

SEQ ID NO: 7196 - protein, 9 aa, Homo Sapiens
QVKTISINQ

SEQ ID NO: 7197 - protein, 9 aa, Homo Sapiens
LSNKDLINY

SEQ ID NO: 7198 - protein, 9 aa, Homo Sapiens
NKFVQSCID

SEQ ID NO: 7199 - protein, 9 aa, Homo Sapiens
VQSCIDWNR

SEQ ID NO: 7200 - protein, 9 aa, Homo Sapiens
QSCIDWNRE

SEQ ID NO: 7201 - protein, 9 aa, Homo Sapiens
IDWNREVLK

SEQ ID NO: 7202 - protein, 9 aa, Homo Sapiens
DWNREVLKR

SEQ ID NO: 7203 - protein, 9 aa, Homo Sapiens
AECDIIDIP

SEQ ID NO: 7204 - protein, 9 aa, Homo Sapiens
IIDIPQLFK

SEQ ID NO: 7205 - protein, 9 aa, Homo Sapiens
QLFKTERKK

SEQ ID NO: 7206 - protein, 9 aa, Homo Sapiens
KTERKKATA

SEQ ID NO: 7207 - protein, 9 aa, Homo Sapiens
KKATAFFPD

SEQ ID NO: 7208 - protein, 9 aa, Homo Sapiens
DLVNMLVLG

SEQ ID NO: 7209 - protein, 9 aa, Homo Sapiens
LVNMLVLGK

SEQ ID NO: 7210 - protein, 9 aa, Homo Sapiens
LGIPKPFGP

SEQ ID NO: 7211 - protein, 9 aa, Homo Sapiens
PFGPIINGC

SEQ ID NO: 7212 - protein, 9 aa, Homo Sapiens
INGCCCLEE

SEQ ID NO: 7213 - protein, 9 aa, Homo Sapiens
EKVRSLLEP

SEQ ID NO: 7214 - protein, 9 aa, Homo Sapiens
SLLEPLGLH

SEQ ID NO: 7215 - protein, 9 aa, Homo Sapiens
LLEPLGLHC

SEQ ID NO: 7216 - protein, 9 aa, Homo Sapiens
LGLHCTFID

SEQ ID NO: 7217 - protein, 9 aa, Homo Sapiens
HCTFIDDFT

SEQ ID NO: 7218 - protein, 9 aa, Homo Sapiens
TFIDDFTPY

SEQ ID NO: 7219 - protein, 9 aa, Homo Sapiens
DFTPYHMLH

SEQ ID NO: 7220 - protein, 9 aa, Homo Sapiens
TPYHMLHGE

SEQ ID NO: 7221 - protein, 9 aa, Homo Sapiens
HCGTNVCRK

SEQ ID NO: 7222 - protein, 9 aa, Homo Sapiens
TNVCRKPFS

SEQ ID NO: 7223 - protein, 9 aa, Homo Sapiens
IVRVSLEHP

SEQ ID NO: 7224 - protein, 9 aa, Homo Sapiens
LEHPTSAVC

SEQ ID NO: 7225 - protein, 9 aa, Homo Sapiens
PTSAVCVAG

SEQ ID NO: 7226 - protein, 9 aa, Homo Sapiens
VAGVETLVD

SEQ ID NO: 7227 - protein, 9 aa, Homo Sapiens
VETLVDIYG

SEQ ID NO: 7228 - protein, 9 aa, Homo Sapiens
EGTEMFEVY

SEQ ID NO: 7229 - protein, 9 aa, Homo Sapiens
ISPNMERGR

SEQ ID NO: 7230 - protein, 9 aa, Homo Sapiens
SPNMERGRE

SEQ ID NO: 7231 - protein, 9 aa, Homo Sapiens
NMERGRERA

SEQ ID NO: 7232 - protein, 9 aa, Homo Sapiens
EIIVVMNSP

SEQ ID NO: 7233 - protein, 9 aa, Homo Sapiens
VVMNSPSND

SEQ ID NO: 7234 - protein, 9 aa, Homo Sapiens
MNSPSNDLN

SEQ ID NO: 7235 - protein, 9 aa, Homo Sapiens
SPSNDLNDS

SEQ ID NO: 7236 - protein, 9 aa, Homo Sapiens
SSHEPLPLA

SEQ ID NO: 7237 - protein, 9 aa, Homo Sapiens
LTCVDISLD

SEQ ID NO: 7238 - protein, 9 aa, Homo Sapiens
DISLDCDLN

SEQ ID NO: 7239 - protein, 9 aa, Homo Sapiens
SLDCDLNCE

SEQ ID NO: 7240 - protein, 9 aa, Homo Sapiens
DLNCEGRQD

SEQ ID NO: 7241 - protein, 9 aa, Homo Sapiens
NCEGRQDRN

SEQ ID NO: 7242 - protein, 9 aa, Homo Sapiens
QDRNFVDKR

SEQ ID NO: 7243 - protein, 9 aa, Homo Sapiens
VDKRQWVWG

SEQ ID NO: 7244 - protein, 9 aa, Homo Sapiens
DKRQWVWGP

SEQ ID NO: 7245 - protein, 9 aa, Homo Sapiens
QWVWGPSGY

SEQ ID NO: 7246 - protein, 9 aa, Homo Sapiens
LLVNCDRDD

SEQ ID NO: 7247 - protein, 9 aa, Homo Sapiens
LVNCDRDDP

SEQ ID NO: 7248 - protein, 9 aa, Homo Sapiens
CDRDDPSCD

SEQ ID NO: 7249 - protein, 9 aa, Homo Sapiens
PSCDVQDNC

SEQ ID NO: 7250 - protein, 9 aa, Homo Sapiens
DVQDNCDQH

SEQ ID NO: 7251 - protein, 9 aa, Homo Sapiens
QDNCDQHVH

SEQ ID NO: 7252 - protein, 9 aa, Homo Sapiens
DNCDQHVHC

SEQ ID NO: 7253 - protein, 9 aa, Homo Sapiens
VHCLQDLED

SEQ ID NO: 7254 - protein, 9 aa, Homo Sapiens
MSVMVLRTQ

SEQ ID NO: 7255 - protein, 9 aa, Homo Sapiens
SVMVLRTQG

SEQ ID NO: 7256 - protein, 9 aa, Homo Sapiens
VMVLRTQGP

SEQ ID NO: 7257 - protein, 9 aa, Homo Sapiens
VLRTQGPAA

SEQ ID NO: 7258 - protein, 9 aa, Homo Sapiens
FDDHKLVLH

SEQ ID NO: 7259 - protein, 9 aa, Homo Sapiens
VLHTSSYDA

SEQ ID NO: 7260 - protein, 9 aa, Homo Sapiens
HTSSYDAKR

SEQ ID NO: 7261 - protein, 9 aa, Homo Sapiens
DAKRAQVFH

SEQ ID NO: 7262 - protein, 9 aa, Homo Sapiens
VFHICGPED

SEQ ID NO: 7263 - protein, 9 aa, Homo Sapiens
CEAYRHVLG

SEQ ID NO: 7264 - protein, 9 aa, Homo Sapiens
LGQDKVSYE

SEQ ID NO: 7265 - protein, 9 aa, Homo Sapiens
SYEVPRLHG

SEQ ID NO: 7266 - protein, 9 aa, Homo Sapiens
DEERFFVEG

SEQ ID NO: 7267 - protein, 9 aa, Homo Sapiens
FFVEGLSFP

SEQ ID NO: 7268 - protein, 9 aa, Homo Sapiens
VEGLSFPDA

SEQ ID NO: 7269 - protein, 9 aa, Homo Sapiens
DAGFTGLIS

SEQ ID NO: 7270 - protein, 9 aa, Homo Sapiens
SFHVTLLDD

SEQ ID NO: 7271 - protein, 9 aa, Homo Sapiens
FHVTLLDDS

SEQ ID NO: 7272 - protein, 9 aa, Homo Sapiens
HVTLLDDSN

SEQ ID NO: 7273 - protein, 9 aa, Homo Sapiens
LDDSNEDFS

SEQ ID NO: 7274 - protein, 9 aa, Homo Sapiens
DSNEDFSAS

SEQ ID NO: 7275 - protein, 9 aa, Homo Sapiens
FSASPIFTD

SEQ ID NO: 7276 - protein, 9 aa, Homo Sapiens
TDTVVFRVA

SEQ ID NO: 7277 - protein, 9 aa, Homo Sapiens
VAPWIMTPS

SEQ ID NO: 7278 - protein, 9 aa, Homo Sapiens
TPSTLPPLE

SEQ ID NO: 7279 - protein, 9 aa, Homo Sapiens
LEVYVCRVR

SEQ ID NO: 7280 - protein, 9 aa, Homo Sapiens
YVCRVRNNT

SEQ ID NO: 7281 - protein, 9 aa, Homo Sapiens
FVDAVAELA

SEQ ID NO: 7282 - protein, 9 aa, Homo Sapiens
VDAVAELAR

SEQ ID NO: 7283 - protein, 9 aa, Homo Sapiens
ELARKAGCK

SEQ ID NO: 7284 - protein, 9 aa, Homo Sapiens
AGCKLTICP

SEQ ID NO: 7285 - protein, 9 aa, Homo Sapiens
LTICPQAEN

SEQ ID NO: 7286 - protein, 9 aa, Homo Sapiens
CPQAENRND

SEQ ID NO: 7287 - protein, 9 aa, Homo Sapiens
QAENRNDRW

SEQ ID NO: 7288 - protein, 9 aa, Homo Sapiens
ENRNDRWIQ

SEQ ID NO: 7289 - protein, 9 aa, Homo Sapiens
DEMELGYVQ

SEQ ID NO: 7290 - protein, 9 aa, Homo Sapiens
VQAPHKTLP

SEQ ID NO: 7291 - protein, 9 aa, Homo Sapiens
LPVVFDSPR

SEQ ID NO: 7292 - protein, 9 aa, Homo Sapiens
VFDSPRNGE

SEQ ID NO: 7293 - protein, 9 aa, Homo Sapiens
ELQDFPYKR

SEQ ID NO: 7294 - protein, 9 aa, Homo Sapiens
PYKRILGPD

SEQ ID NO: 7295 - protein, 9 aa, Homo Sapiens
LGPDFGYVT

SEQ ID NO: 7296 - protein, 9 aa, Homo Sapiens
YVTREPRDR

SEQ ID NO: 7297 - protein, 9 aa, Homo Sapiens
VTREPRDRS

SEQ ID NO: 7298 - protein, 9 aa, Homo Sapiens
EPRDRSVSG

SEQ ID NO: 7299 - protein, 9 aa, Homo Sapiens
VSGLDSFGN

SEQ ID NO: 7300 - protein, 9 aa, Homo Sapiens
SFGNLEVSP

SEQ ID NO: 7301 - protein, 9 aa, Homo Sapiens
FGNLEVSPP

SEQ ID NO: 7302 - protein, 9 aa, Homo Sapiens
SPPVVANGK

SEQ ID NO: 7303 - protein, 9 aa, Homo Sapiens
PPVVANGKE

SEQ ID NO: 7304 - protein, 9 aa, Homo Sapiens
PVVANGKEY

SEQ ID NO: 7305 - protein, 9 aa, Homo Sapiens
NGKEYPLGR

SEQ ID NO: 7306 - protein, 9 aa, Homo Sapiens
PLGRILIGG

SEQ ID NO: 7307 - protein, 9 aa, Homo Sapiens
LIGGNLPGS

SEQ ID NO: 7308 - protein, 9 aa, Homo Sapiens
IGGNLPGSS

SEQ ID NO: 7309 - protein, 9 aa, Homo Sapiens
NLPGSSGRR

SEQ ID NO: 7310 - protein, 9 aa, Homo Sapiens
PGSSGRRVT

SEQ ID NO: 7311 - protein, 9 aa, Homo Sapiens
TQVVRDFLH

SEQ ID NO: 7312 - protein, 9 aa, Homo Sapiens
LHAQKVQPP

SEQ ID NO: 7313 - protein, 9 aa, Homo Sapiens
LFVDWLAVG

SEQ ID NO: 7314 - protein, 9 aa, Homo Sapiens
WLAVGHVDE

SEQ ID NO: 7315 - protein, 9 aa, Homo Sapiens
VGHVDEFLS

SEQ ID NO: 7316 - protein, 9 aa, Homo Sapiens
PGACFKLFQ

SEQ ID NO: 7317 - protein, 9 aa, Homo Sapiens
HGRALLFQG

SEQ ID NO: 7318 - protein, 9 aa, Homo Sapiens
LFQGVVDDE

SEQ ID NO: 7319 - protein, 9 aa, Homo Sapiens
VVDDEQVKT

SEQ ID NO: 7320 - protein, 9 aa, Homo Sapiens
EQVKTISIN

SEQ ID NO: 7321 - protein, 9 aa, Homo Sapiens
TISINQVLS

SEQ ID NO: 7322 - protein, 9 aa, Homo Sapiens
SINQVLSNK

SEQ ID NO: 7323 - protein, 9 aa, Homo Sapiens
INQVLSNKD

SEQ ID NO: 7324 - protein, 9 aa, Homo Sapiens
VLSNKDLIN

SEQ ID NO: 7325 - protein, 9 aa, Homo Sapiens
NYNKFVQSC

SEQ ID NO: 7326 - protein, 9 aa, Homo Sapiens
FVQSCIDWN

SEQ ID NO: 7327 - protein, 9 aa, Homo Sapiens
WNREVLKRE

SEQ ID NO: 7328 - protein, 9 aa, Homo Sapiens
LKRELGLAE

SEQ ID NO: 7329 - protein, 9 aa, Homo Sapiens
ECDIIDIPQ

SEQ ID NO: 7330 - protein, 9 aa, Homo Sapiens
IPQLFKTER

SEQ ID NO: 7331 - protein, 9 aa, Homo Sapiens
FKTERKKAT

SEQ ID NO: 7332 - protein, 9 aa, Homo Sapiens
MLVLGKHLG

SEQ ID NO: 7333 - protein, 9 aa, Homo Sapiens
HLGIPKPFG

SEQ ID NO: 7334 - protein, 9 aa, Homo Sapiens
FGPIINGCC

SEQ ID NO: 7335 - protein, 9 aa, Homo Sapiens
IINGCCCLE

SEQ ID NO: 7336 - protein, 9 aa, Homo Sapiens
EEKVRSLLE

SEQ ID NO: 7337 - protein, 9 aa, Homo Sapiens
FIDDFTPYH

SEQ ID NO: 7338 - protein, 9 aa, Homo Sapiens
FTPYHMLHG

SEQ ID NO: 7339 - protein, 9 aa, Homo Sapiens
MLHGEVHCG

SEQ ID NO: 7340 - protein, 9 aa, Homo Sapiens
VHCGTNVCR

SEQ ID NO: 7341 - protein, 9 aa, Homo Sapiens
CGTNVCRKP

SEQ ID NO: 7342 - protein, 9 aa, Homo Sapiens
MTPSTLAPL

SEQ ID NO: 7343 - protein, 9 aa, Homo Sapiens
PSTLAPLEV

SEQ ID NO: 7344 - protein, 9 aa, Homo Sapiens
TLAPLEVYV

SEQ ID NO: 7345 - protein, 9 aa, Homo Sapiens
IMTPSTLAP

SEQ ID NO: 7346 - protein, 9 aa, Homo Sapiens
APLEVYVCR

SEQ ID NO: 7347 - protein, 9 aa, Homo Sapiens
TPSTLAPLE

SEQ ID NO: 7348 - protein, 9 aa, Homo Sapiens
STLAPLEVY

SEQ ID NO: 7349 - protein, 9 aa, Homo Sapiens
LAPLEVYVC

SEQ ID NO: 7350 - protein, 9 aa, Homo Sapiens
DEFLSFVPV

SEQ ID NO: 7351 - protein, 9 aa, Homo Sapiens
VPVPDGKGF

SEQ ID NO: 7352 - protein, 9 aa, Homo Sapiens
VPDGKGFRM

SEQ ID NO: 7353 - protein, 9 aa, Homo Sapiens
EFLSFVPVP

SEQ ID NO: 7354 - protein, 9 aa, Homo Sapiens
LSFVPVPDG

SEQ ID NO: 7355 - protein, 9 aa, Homo Sapiens
SFVPVPDGK

SEQ ID NO: 7356 - protein, 9 aa, Homo Sapiens
FLSFVPVPD

SEQ ID NO: 7357 - protein, 9 aa, Homo Sapiens
KEYPLGRIL

SEQ ID NO: 7358 - protein, 9 aa, Homo Sapiens
AENRNDRWI

SEQ ID NO: 7359 - protein, 9 aa, Homo Sapiens
LEDMSVMVL

SEQ ID NO: 7360 - protein, 9 aa, Homo Sapiens
EERFFVEGL

SEQ ID NO: 7361 - protein, 9 aa, Homo Sapiens
TERKKATAF

SEQ ID NO: 7362 - protein, 9 aa, Homo Sapiens
RERADTRRW

SEQ ID NO: 7363 - protein, 9 aa, Homo Sapiens
CEGRQDRNF

SEQ ID NO: 7364 - protein, 9 aa, Homo Sapiens
LEEKVRSLL

SEQ ID NO: 7365 - protein, 9 aa, Homo Sapiens
NEDFSASPI

SEQ ID NO: 7366 - protein, 9 aa, Homo Sapiens
DEQVKTISI

SEQ ID NO: 7367 - protein, 9 aa, Homo Sapiens
SHEPLPLAY

SEQ ID NO: 7368 - protein, 9 aa, Homo Sapiens
AGFTGLISF

SEQ ID NO: 7369 - protein, 9 aa, Homo Sapiens
AECDIIDIP

SEQ ID NO: 7370 - protein, 9 aa, Homo Sapiens
STLPPLEVY

SEQ ID NO: 7371 - protein, 9 aa, Homo Sapiens
CDIIDIPQL

SEQ ID NO: 7372 - protein, 9 aa, Homo Sapiens
DIIDIPQLF

SEQ ID NO: 7373 - protein, 9 aa, Homo Sapiens
KHLGIPKPF

SEQ ID NO: 7374 - protein, 9 aa, Homo Sapiens
AALFDDHKL

SEQ ID NO: 7375 - protein, 9 aa, Homo Sapiens
YEVPRLHGD

SEQ ID NO: 7376 - protein, 9 aa, Homo Sapiens
PIFTDTVVF

SEQ ID NO: 7377 - protein, 9 aa, Homo Sapiens
QDFPYKRIL

SEQ ID NO: 7378 - protein, 9 aa, Homo Sapiens
KVQPPVELF

SEQ ID NO: 7379 - protein, 9 aa, Homo Sapiens
ASPGACFKL

SEQ ID NO: 7380 - protein, 9 aa, Homo Sapiens
KTISINQVL

SEQ ID NO: 7381 - protein, 9 aa, Homo Sapiens
MERGRERAD

SEQ ID NO: 7382 - protein, 9 aa, Homo Sapiens
GLISFHVTL

SEQ ID NO: 7383 - protein, 9 aa, Homo Sapiens
PWIMTPSTL

SEQ ID NO: 7384 - protein, 9 aa, Homo Sapiens
AELARKAGC

SEQ ID NO: 7385 - protein, 9 aa, Homo Sapiens
MELGYVQAP

SEQ ID NO: 7386 - protein, 9 aa, Homo Sapiens
FDSPRNGEL

SEQ ID NO: 7387 - protein, 9 aa, Homo Sapiens
EYPLGRILI

SEQ ID NO: 7388 - protein, 9 aa, Homo Sapiens
GRILIGGNL

SEQ ID NO: 7389 - protein, 9 aa, Homo Sapiens
DEFLSFVPA

SEQ ID NO: 7390 - protein, 9 aa, Homo Sapiens
VPAPDGKGF

SEQ ID NO: 7391 - protein, 9 aa, Homo Sapiens
SPGACFKLF

SEQ ID NO: 7392 - protein, 9 aa, Homo Sapiens
CGHGRALLF

SEQ ID NO: 7393 - protein, 9 aa, Homo Sapiens
KDLINYNKF

SEQ ID NO: 7394 - protein, 9 aa, Homo Sapiens
EVLKRELGL

SEQ ID NO: 7395 - protein, 9 aa, Homo Sapiens
EEKVRSLLE

SEQ ID NO: 7396 - protein, 9 aa, Homo Sapiens
EPLGLHCTF

SEQ ID NO: 7397 - protein, 9 aa, Homo Sapiens
TFIDDFTPY

SEQ ID NO: 7398 - protein, 9 aa, Homo Sapiens
LEHPTSAVC

SEQ ID NO: 7399 - protein, 9 aa, Homo Sapiens
EGTEMFEVY

SEQ ID NO: 7400 - protein, 9 aa, Homo Sapiens
YGTPGVDIY

SEQ ID NO: 7401 - protein, 9 aa, Homo Sapiens
RADTRRWRF

SEQ ID NO: 7402 - protein, 9 aa, Homo Sapiens
LEIIVVMNS

SEQ ID NO: 7403 - protein, 9 aa, Homo Sapiens
LPLAYAVLY

SEQ ID NO: 7404 - protein, 9 aa, Homo Sapiens
RNFVDKRQW

SEQ ID NO: 7405 - protein, 9 aa, Homo Sapiens
NCDQHVHCL

SEQ ID NO: 7406 - protein, 9 aa, Homo Sapiens
LFDDHKLVL

SEQ ID NO: 7407 - protein, 9 aa, Homo Sapiens
EDFSASPIF

SEQ ID NO: 7408 - protein, 9 aa, Homo Sapiens
PHKTLPVVF

SEQ ID NO: 7409 - protein, 9 aa, Homo Sapiens
REPRDRSVS

SEQ ID NO: 7410 - protein, 9 aa, Homo Sapiens
SGLDSFGNL

SEQ ID NO: 7411 - protein, 9 aa, Homo Sapiens
QKCGHGRAL

SEQ ID NO: 7412 - protein, 9 aa, Homo Sapiens
NQVLSNKDL

SEQ ID NO: 7413 - protein, 9 aa, Homo Sapiens
CIDWNREVL

SEQ ID NO: 7414 - protein, 9 aa, Homo Sapiens
FFPDLVNML

SEQ ID NO: 7415 - protein, 9 aa, Homo Sapiens
PDLVNMLVL

SEQ ID NO: 7416 - protein, 9 aa, Homo Sapiens
NMLVLGKHL

SEQ ID NO: 7417 - protein, 9 aa, Homo Sapiens
PIINGCCCL

SEQ ID NO: 7418 - protein, 9 aa, Homo Sapiens
RSLLEPLGL

SEQ ID NO: 7419 - protein, 9 aa, Homo Sapiens
LEPLGLHCT

SEQ ID NO: 7420 - protein, 9 aa, Homo Sapiens
LHCTFIDDF

SEQ ID NO: 7421 - protein, 9 aa, Homo Sapiens
DDFTPYHML

SEQ ID NO: 7422 - protein, 9 aa, Homo Sapiens
CRKPFSFKW

SEQ ID NO: 7423 - protein, 9 aa, Homo Sapiens
RKPFSFKWW

SEQ ID NO: 7424 - protein, 9 aa, Homo Sapiens
AGVETLVDI

SEQ ID NO: 7425 - protein, 9 aa, Homo Sapiens
SVPEGTEMF

SEQ ID NO: 7426 - protein, 9 aa, Homo Sapiens
WRFDATLEI

SEQ ID NO: 7427 - protein, 9 aa, Homo Sapiens
NDSHVQISY

SEQ ID NO: 7428 - protein, 9 aa, Homo Sapiens
HSSHEPLPL

SEQ ID NO: 7429 - protein, 9 aa, Homo Sapiens
HEPLPLAYA

SEQ ID NO: 7430 - protein, 9 aa, Homo Sapiens
PLPLAYAVL

SEQ ID NO: 7431 - protein, 9 aa, Homo Sapiens
VDISLDCDL

SEQ ID NO: 7432 - protein, 9 aa, Homo Sapiens
FVDKRQWVW

SEQ ID NO: 7433 - protein, 9 aa, Homo Sapiens
LRTQGPAAL

SEQ ID NO: 7434 - protein, 9 aa, Homo Sapiens
RTQGPAALF

SEQ ID NO: 7435 - protein, 9 aa, Homo Sapiens
KLVLHTSSY

SEQ ID NO: 7436 - protein, 9 aa, Homo Sapiens
YDAKRAQVF

SEQ ID NO: 7437 - protein, 9 aa, Homo Sapiens
GPEDVCEAY

SEQ ID NO: 7438 - protein, 9 aa, Homo Sapiens
VCEAYRHVL

SEQ ID NO: 7439 - protein, 9 aa, Homo Sapiens
CEAYRHVLG

SEQ ID NO: 7440 - protein, 9 aa, Homo Sapiens
KVSYEVPRL

SEQ ID NO: 7441 - protein, 9 aa, Homo Sapiens
DEERFFVEG

SEQ ID NO: 7442 - protein, 9 aa, Homo Sapiens
RFFVEGLSF

SEQ ID NO: 7443 - protein, 9 aa, Homo Sapiens
LISFHVTLL

SEQ ID NO: 7444 - protein, 9 aa, Homo Sapiens
RWIQDEMEL

SEQ ID NO: 7445 - protein, 9 aa, Homo Sapiens
YVQAPHKTL

SEQ ID NO: 7446 - protein, 9 aa, Homo Sapiens
PRDRSVSGL

SEQ ID NO: 7447 - protein, 9 aa, Homo Sapiens
LEVSPPVVA

SEQ ID NO: 7448 - protein, 9 aa, Homo Sapiens
PVVANGKEY

SEQ ID NO: 7449 - protein, 9 aa, Homo Sapiens
AVGHVDEFL

SEQ ID NO: 7450 - protein, 9 aa, Homo Sapiens
GHVDEFLSF

SEQ ID NO: 7451 - protein, 9 aa, Homo Sapiens
DGKGFRMLL

SEQ ID NO: 7452 - protein, 9 aa, Homo Sapiens
KCGHGRALL

SEQ ID NO: 7453 - protein, 9 aa, Homo Sapiens
VDDEQVKTI

SEQ ID NO: 7454 - protein, 9 aa, Homo Sapiens
REVLKRELG

SEQ ID NO: 7455 - protein, 9 aa, Homo Sapiens
RELGLAECD

SEQ ID NO: 7456 - protein, 9 aa, Homo Sapiens
ERKKATAFF

SEQ ID NO: 7457 - protein, 9 aa, Homo Sapiens
GTNVCRKPF

SEQ ID NO: 7458 - protein, 9 aa, Homo Sapiens
NVCRKPFSF

SEQ ID NO: 7459 - protein, 9 aa, Homo Sapiens
LQRIVRVSL

SEQ ID NO: 7460 - protein, 9 aa, Homo Sapiens
VCVAGVETL

SEQ ID NO: 7461 - protein, 9 aa, Homo Sapiens
GVETLVDIY

SEQ ID NO: 7462 - protein, 9 aa, Homo Sapiens
VETLVDIYG

SEQ ID NO: 7463 - protein, 9 aa, Homo Sapiens
TEMFEVYGT

SEQ ID NO: 7464 - protein, 9 aa, Homo Sapiens
RRWRFDATL

SEQ ID NO: 7465 - protein, 9 aa, Homo Sapiens
PLAYAVLYL

SEQ ID NO: 7466 - protein, 9 aa, Homo Sapiens
GPSGYGGIL

SEQ ID NO: 7467 - protein, 9 aa, Homo Sapiens
PSGYGGILL

SEQ ID NO: 7468 - protein, 9 aa, Homo Sapiens
AKRAQVFHI

SEQ ID NO: 7469 - protein, 9 aa, Homo Sapiens
LHGDEERFF

SEQ ID NO: 7470 - protein, 9 aa, Homo Sapiens
VEGLSFPDA

SEQ ID NO: 7471 - protein, 9 aa, Homo Sapiens
FPDAGFTGL

SEQ ID NO: 7472 - protein, 9 aa, Homo Sapiens
LLDDSNEDF

SEQ ID NO: 7473 - protein, 9 aa, Homo Sapiens
TVVFRVAPW

SEQ ID NO: 7474 - protein, 9 aa, Homo Sapiens
VVFRVAPWI

SEQ ID NO: 7475 - protein, 9 aa, Homo Sapiens
MTPSTLPPL

SEQ ID NO: 7476 - protein, 9 aa, Homo Sapiens
LEVYVCRVR

SEQ ID NO: 7477 - protein, 9 aa, Homo Sapiens
CRVRNNTCF

SEQ ID NO: 7478 - protein, 9 aa, Homo Sapiens
CFVDAVAEL

SEQ ID NO: 7479 - protein, 9 aa, Homo Sapiens
QAENRNDRW

SEQ ID NO: 7480 - protein, 9 aa, Homo Sapiens
IQDEMELGY

SEQ ID NO: 7481 - protein, 9 aa, Homo Sapiens
DEMELGYVQ

SEQ ID NO: 7482 - protein, 9 aa, Homo Sapiens
PRNGELQDF

SEQ ID NO: 7483 - protein, 9 aa, Homo Sapiens
NGELQDFPY

SEQ ID NO: 7484 - protein, 9 aa, Homo Sapiens
GELQDFPYK

SEQ ID NO: 7485 - protein, 9 aa, Homo Sapiens
RILGPDFGY

SEQ ID NO: 7486 - protein, 9 aa, Homo Sapiens
RVTQVVRDF

SEQ ID NO: 7487 - protein, 9 aa, Homo Sapiens
QKVQPPVEL

SEQ ID NO: 7488 - protein, 9 aa, Homo Sapiens
PPVELFVDW

SEQ ID NO: 7489 - protein, 9 aa, Homo Sapiens
PVELFVDWL

SEQ ID NO: 7490 - protein, 9 aa, Homo Sapiens
VELFVDWLA

SEQ ID NO: 7491 - protein, 9 aa, Homo Sapiens
LAVGHVDEF

SEQ ID NO: 7492 - protein, 9 aa, Homo Sapiens
PDGKGFRML

SEQ ID NO: 7493 - protein, 9 aa, Homo Sapiens
LSNKDLINY

SEQ ID NO: 7494 - protein, 9 aa, Homo Sapiens
KFVQSCIDW

SEQ ID NO: 7495 - protein, 9 aa, Homo Sapiens
NREVLKREL

SEQ ID NO: 7496 - protein, 9 aa, Homo Sapiens
LAECDIIDI

SEQ ID NO: 7497 - protein, 9 aa, Homo Sapiens
KATAFFPDL

SEQ ID NO: 7498 - protein, 9 aa, Homo Sapiens
CLEEKVRSL

SEQ ID NO: 7499 - protein, 9 aa, Homo Sapiens
KVRSLLEPL

SEQ ID NO: 7500 - protein, 9 aa, Homo Sapiens
PEGTEMFEV

SEQ ID NO: 7501 - protein, 9 aa, Homo Sapiens
FEVYGTPGV

SEQ ID NO: 7502 - protein, 9 aa, Homo Sapiens
GTPGVDIYI

SEQ ID NO: 7503 - protein, 9 aa, Homo Sapiens
VMNSPSNDL

SEQ ID NO: 7504 - protein, 9 aa, Homo Sapiens
DLNDSHVQI

SEQ ID NO: 7505 - protein, 9 aa, Homo Sapiens
SYHSSHEPL

SEQ ID NO: 7506 - protein, 9 aa, Homo Sapiens
YLTCVDISL

SEQ ID NO: 7507 - protein, 9 aa, Homo Sapiens
QWVWGPSGY

SEQ ID NO: 7508 - protein, 9 aa, Homo Sapiens
QHVHCLQDL

SEQ ID NO: 7509 - protein, 9 aa, Homo Sapiens
PEDVCEAYR

SEQ ID NO: 7510 - protein, 9 aa, Homo Sapiens
VLGQDKVSY

SEQ ID NO: 7511 - protein, 9 aa, Homo Sapiens
RLHGDEERF

SEQ ID NO: 7512 - protein, 9 aa, Homo Sapiens
GLSFPDAGF

SEQ ID NO: 7513 - protein, 9 aa, Homo Sapiens
PDAGFTGLI

SEQ ID NO: 7514 - protein, 9 aa, Homo Sapiens
LARKAGCKL

SEQ ID NO: 7515 - protein, 9 aa, Homo Sapiens
RKAGCKLTI

SEQ ID NO: 7516 - protein, 9 aa, Homo Sapiens
LQDFPYKRI

SEQ ID NO: 7517 - protein, 9 aa, Homo Sapiens
RSVSGLDSF

SEQ ID NO: 7518 - protein, 9 aa, Homo Sapiens
VANGKEYPL

SEQ ID NO: 7519 - protein, 9 aa, Homo Sapiens
VTQVVRDFL

SEQ ID NO: 7520 - protein, 9 aa, Homo Sapiens
QVLSNKDLI

SEQ ID NO: 7521 - protein, 9 aa, Homo Sapiens
ELGLAECDI

SEQ ID NO: 7522 - protein, 9 aa, Homo Sapiens
LVLGKHLGI

SEQ ID NO: 7523 - protein, 9 aa, Homo Sapiens
IPKPFGPII

SEQ ID NO: 7524 - protein, 9 aa, Homo Sapiens
VYGTPGVDI

SEQ ID NO: 7525 - protein, 9 aa, Homo Sapiens
RFDATLEII

SEQ ID NO: 7526 - protein, 9 aa, Homo Sapiens
ATLEIIVVM

SEQ ID NO: 7527 - protein, 9 aa, Homo Sapiens
VLYLTCVDI

SEQ ID NO: 7528 - protein, 9 aa, Homo Sapiens
YKRILGPDF

SEQ ID NO: 7529 - protein, 9 aa, Homo Sapiens
EVSPPVVAN

SEQ ID NO: 7530 - protein, 9 aa, Homo Sapiens
LLASPGACF

SEQ ID NO: 7531 - protein, 9 aa, Homo Sapiens
QEKQKCGHG

SEQ ID NO: 7532 - protein, 9 aa, Homo Sapiens
AFFPDLVNM

SEQ ID NO: 7533 - protein, 9 aa, Homo Sapiens
GIPKPFGPI

SEQ ID NO: 7534 - protein, 9 aa, Homo Sapiens
GEVHCGTNV

SEQ ID NO: 7535 - protein, 9 aa, Homo Sapiens
EPLPLAYAV

SEQ ID NO: 7536 - protein, 9 aa, Homo Sapiens
WGPSGYGGI

SEQ ID NO: 7537 - protein, 9 aa, Homo Sapiens
ALFDDHKLV

SEQ ID NO: 7538 - protein, 9 aa, Homo Sapiens
GKEYPLGRI

SEQ ID NO: 7539 - protein, 9 aa, Homo Sapiens
LGLAECDII

SEQ ID NO: 7540 - protein, 9 aa, Homo Sapiens
PLGLHCTFI

SEQ ID NO: 7541 - protein, 9 aa, Homo Sapiens
KGFRMLLAS

SEQ ID NO: 7542 - protein, 9 aa, Homo Sapiens
YNKFVQSCI

SEQ ID NO: 7543 - protein, 9 aa, Homo Sapiens
IDIPQLFKT

SEQ ID NO: 7544 - protein, 9 aa, Homo Sapiens
KPFGPIING

SEQ ID NO: 7545 - protein, 9 aa, Homo Sapiens
PFGPIINGC

SEQ ID NO: 7546 - protein, 9 aa, Homo Sapiens
SGYGGILLV

SEQ ID NO: 7547 - protein, 9 aa, Homo Sapiens
SASPIFTDT

SEQ ID NO: 7548 - protein, 9 aa, Homo Sapiens
RVAPWIMTP

SEQ ID NO: 7549 - protein, 9 aa, Homo Sapiens
YPLGRILIG

SEQ ID NO: 7550 - protein, 9 aa, Homo Sapiens
ELFVDWLAV

SEQ ID NO: 7551 - protein, 9 aa, Homo Sapiens
LGIPKPFGP

SEQ ID NO: 7552 - protein, 9 aa, Homo Sapiens
MSLQRIVRV

SEQ ID NO: 7553 - protein, 9 aa, Homo Sapiens
SLQRIVRVS

SEQ ID NO: 7554 - protein, 9 aa, Homo Sapiens
QRIVRVSLE

SEQ ID NO: 7555 - protein, 9 aa, Homo Sapiens
EHPTSAVCV

SEQ ID NO: 7556 - protein, 9 aa, Homo Sapiens
ETLVDIYGS

SEQ ID NO: 7557 - protein, 9 aa, Homo Sapiens
ADTRRWRFD

SEQ ID NO: 7558 - protein, 9 aa, Homo Sapiens
DATLEIIVV

SEQ ID NO: 7559 - protein, 9 aa, Homo Sapiens
EIIVVMNSP

SEQ ID NO: 7560 - protein, 9 aa, Homo Sapiens
AVLYLTCVD

SEQ ID NO: 7561 - protein, 9 aa, Homo Sapiens
GGILLVNCD

SEQ ID NO: 7562 - protein, 9 aa, Homo Sapiens
AQVFHICGP

SEQ ID NO: 7563 - protein, 9 aa, Homo Sapiens
EGLSFPDAG

SEQ ID NO: 7564 - protein, 9 aa, Homo Sapiens
LSFPDAGFT

SEQ ID NO: 7565 - protein, 9 aa, Homo Sapiens
ASPIFTDTV

SEQ ID NO: 7566 - protein, 9 aa, Homo Sapiens
TCFVDAVAE

SEQ ID NO: 7567 - protein, 9 aa, Homo Sapiens
AVAELARKA

SEQ ID NO: 7568 - protein, 9 aa, Homo Sapiens
VAELARKAG

SEQ ID NO: 7569 - protein, 9 aa, Homo Sapiens
ARKAGCKLT

SEQ ID NO: 7570 - protein, 9 aa, Homo Sapiens
KTLPVVFDS

SEQ ID NO: 7571 - protein, 9 aa, Homo Sapiens
KRILGPDFG

SEQ ID NO: 7572 - protein, 9 aa, Homo Sapiens
DSFGNLEVS

SEQ ID NO: 7573 - protein, 9 aa, Homo Sapiens
GSSGRRVTQ

SEQ ID NO: 7574 - protein, 9 aa, Homo Sapiens
EFLSFVPAP

SEQ ID NO: 7575 - protein, 9 aa, Homo Sapiens
ACFKLFQEK

SEQ ID NO: 7576 - protein, 9 aa, Homo Sapiens
ALLFQGVVD

SEQ ID NO: 7577 - protein, 9 aa, Homo Sapiens
ISINQVLSN

SEQ ID NO: 7578 - protein, 9 aa, Homo Sapiens
SNKDLINYN

SEQ ID NO: 7579 - protein, 9 aa, Homo Sapiens
DLINYNKFV

SEQ ID NO: 7580 - protein, 9 aa, Homo Sapiens
SCIDWNREV

SEQ ID NO: 7581 - protein, 9 aa, Homo Sapiens
EMFEVYGTP

SEQ ID NO: 7582 - protein, 9 aa, Homo Sapiens
EVYGTPGVD

SEQ ID NO: 7583 - protein, 9 aa, Homo Sapiens
YISPNMERG

SEQ ID NO: 7584 - protein, 9 aa, Homo Sapiens
ERADTRRWR

SEQ ID NO: 7585 - protein, 9 aa, Homo Sapiens
MNSPSNDLN

SEQ ID NO: 7586 - protein, 9 aa, Homo Sapiens
SPSNDLNDS

SEQ ID NO: 7587 - protein, 9 aa, Homo Sapiens
NDLNDSHVQ

SEQ ID NO: 7588 - protein, 9 aa, Homo Sapiens
AYAVLYLTC

SEQ ID NO: 7589 - protein, 9 aa, Homo Sapiens
RQDRNFVDK

SEQ ID NO: 7590 - protein, 9 aa, Homo Sapiens
GYGGILLVN

SEQ ID NO: 7591 - protein, 9 aa, Homo Sapiens
RDDPSCDVQ

SEQ ID NO: 7592 - protein, 9 aa, Homo Sapiens
EDMSVMVLR

SEQ ID NO: 7593 - protein, 9 aa, Homo Sapiens
TQGPAALFD

SEQ ID NO: 7594 - protein, 9 aa, Homo Sapiens
SSYDAKRAQ

SEQ ID NO: 7595 - protein, 9 aa, Homo Sapiens
EAYRHVLGQ

SEQ ID NO: 7596 - protein, 9 aa, Homo Sapiens
AYRHVLGQD

SEQ ID NO: 7597 - protein, 9 aa, Homo Sapiens
HVLGQDKVS

SEQ ID NO: 7598 - protein, 9 aa, Homo Sapiens
ERFFVEGLS

SEQ ID NO: 7599 - protein, 9 aa, Homo Sapiens
ISFHVTLLD

SEQ ID NO: 7600 - protein, 9 aa, Homo Sapiens
SPIFTDTVV

SEQ ID NO: 7601 - protein, 9 aa, Homo Sapiens
IMTPSTLPP

SEQ ID NO: 7602 - protein, 9 aa, Homo Sapiens
TLPPLEVYV

SEQ ID NO: 7603 - protein, 9 aa, Homo Sapiens
AGCKLTICP

SEQ ID NO: 7604 - protein, 9 aa, Homo Sapiens
NRNDRWIQD

SEQ ID NO: 7605 - protein, 9 aa, Homo Sapiens
RNDRWIQDE

SEQ ID NO: 7606 - protein, 9 aa, Homo Sapiens
EMELGYVQA

SEQ ID NO: 7607 - protein, 9 aa, Homo Sapiens
APHKTLPVV

SEQ ID NO: 7608 - protein, 9 aa, Homo Sapiens
VVFDSPRNG

SEQ ID NO: 7609 - protein, 9 aa, Homo Sapiens
ELQDFPYKR

SEQ ID NO: 7610 - protein, 9 aa, Homo Sapiens
FPYKRILGP

SEQ ID NO: 7611 - protein, 9 aa, Homo Sapiens
TREPRDRSV

SEQ ID NO: 7612 - protein, 9 aa, Homo Sapiens
EPRDRSVSG

SEQ ID NO: 7613 - protein, 9 aa, Homo Sapiens
VSPPVVANG

SEQ ID NO: 7614 - protein, 9 aa, Homo Sapiens
ILIGGNLPG

SEQ ID NO: 7615 - protein, 9 aa, Homo Sapiens
SSGRRVTQV

SEQ ID NO: 7616 - protein, 9 aa, Homo Sapiens
VVRDFLHAQ

SEQ ID NO: 7617 - protein, 9 aa, Homo Sapiens
RDFLHAQKV

SEQ ID NO: 7618 - protein, 9 aa, Homo Sapiens
AQKVQPPVE

SEQ ID NO: 7619 - protein, 9 aa, Homo Sapiens
VQPPVELFV

SEQ ID NO: 7620 - protein, 9 aa, Homo Sapiens
SFVPAPDGK

SEQ ID NO: 7621 - protein, 9 aa, Homo Sapiens
APDGKGFRM

SEQ ID NO: 7622 - protein, 9 aa, Homo Sapiens
LASPGACFK

SEQ ID NO: 7623 - protein, 9 aa, Homo Sapiens
EQVKTISIN

SEQ ID NO: 7624 - protein, 9 aa, Homo Sapiens
VKTISINQV

SEQ ID NO: 7625 - protein, 9 aa, Homo Sapiens
ECDIIDIPQ

SEQ ID NO: 7626 - protein, 9 aa, Homo Sapiens
DIPQLFKTE

SEQ ID NO: 7627 - protein, 9 aa, Homo Sapiens
LFKTERKKA

SEQ ID NO: 7628 - protein, 9 aa, Homo Sapiens
FKTERKKAT

SEQ ID NO: 7629 - protein, 9 aa, Homo Sapiens
ATAFFPDLV

SEQ ID NO: 7630 - protein, 9 aa, Homo Sapiens
GKHLGIPKP

SEQ ID NO: 7631 - protein, 9 aa, Homo Sapiens
EKVRSLLEP

SEQ ID NO: 7632 - protein, 9 aa, Homo Sapiens
EVHCGTNVC

SEQ ID NO: 7633 - protein, 9 aa, Homo Sapiens
SLEHPTSAV

SEQ ID NO: 7634 - protein, 9 aa, Homo Sapiens
PTSAVCVAG

SEQ ID NO: 7635 - protein, 9 aa, Homo Sapiens
AVCVAGVET

SEQ ID NO: 7636 - protein, 9 aa, Homo Sapiens
VDIYGSVPE

SEQ ID NO: 7637 - protein, 9 aa, Homo Sapiens
GVDIYISPN

SEQ ID NO: 7638 - protein, 9 aa, Homo Sapiens
VDIYISPNM

SEQ ID NO: 7639 - protein, 9 aa, Homo Sapiens
ERGRERADT

SEQ ID NO: 7640 - protein, 9 aa, Homo Sapiens
TRRWRFDAT

SEQ ID NO: 7641 - protein, 9 aa, Homo Sapiens
NSPSNDLND

SEQ ID NO: 7642 - protein, 9 aa, Homo Sapiens
SNDLNDSHV

SEQ ID NO: 7643 - protein, 9 aa, Homo Sapiens
LTCVDISLD

SEQ ID NO: 7644 - protein, 9 aa, Homo Sapiens
SLDCDLNCE

SEQ ID NO: 7645 - protein, 9 aa, Homo Sapiens
EGRQDRNFV

SEQ ID NO: 7646 - protein, 9 aa, Homo Sapiens
SVMVLRTQG

SEQ ID NO: 7647 - protein, 9 aa, Homo Sapiens
FDDHKLVLH

SEQ ID NO: 7648 - protein, 9 aa, Homo Sapiens
DHKLVLHTS

SEQ ID NO: 7649 - protein, 9 aa, Homo Sapiens
TSSYDAKRA

SEQ ID NO: 7650 - protein, 9 aa, Homo Sapiens
SYDAKRAQV

SEQ ID NO: 7651 - protein, 9 aa, Homo Sapiens
FHICGPEDV

SEQ ID NO: 7652 - protein, 9 aa, Homo Sapiens
ICGPEDVCE

SEQ ID NO: 7653 - protein, 9 aa, Homo Sapiens
EVPRLHGDE

SEQ ID NO: 7654 - protein, 9 aa, Homo Sapiens
SFPDAGFTG

SEQ ID NO: 7655 - protein, 9 aa, Homo Sapiens
GFTGLISFH

SEQ ID NO: 7656 - protein, 9 aa, Homo Sapiens
TGLISFHVT

SEQ ID NO: 7657 - protein, 9 aa, Homo Sapiens
FSASPIFTD

SEQ ID NO: 7658 - protein, 9 aa, Homo Sapiens
DTVVFRVAP

SEQ ID NO: 7659 - protein, 9 aa, Homo Sapiens
APWIMTPST

SEQ ID NO: 7660 - protein, 9 aa, Homo Sapiens
TPSTLPPLE

SEQ ID NO: 7661 - protein, 9 aa, Homo Sapiens
LPPLEVYVC

SEQ ID NO: 7662 - protein, 9 aa, Homo Sapiens
EVYVCRVRN

SEQ ID NO: 7663 - protein, 9 aa, Homo Sapiens
NNTCFVDAV

SEQ ID NO: 7664 - protein, 9 aa, Homo Sapiens
ELARKAGCK

SEQ ID NO: 7665 - protein, 9 aa, Homo Sapiens
GCKLTICPQ

SEQ ID NO: 7666 - protein, 9 aa, Homo Sapiens
CKLTICPQA

SEQ ID NO: 7667 - protein, 9 aa, Homo Sapiens
KLTICPQAE

SEQ ID NO: 7668 - protein, 9 aa, Homo Sapiens
TICPQAENR

SEQ ID NO: 7669 - protein, 9 aa, Homo Sapiens
ENRNDRWIQ

SEQ ID NO: 7670 - protein, 9 aa, Homo Sapiens
VQAPHKTLP

SEQ ID NO: 7671 - protein, 9 aa, Homo Sapiens
DSPRNGELQ

SEQ ID NO: 7672 - protein, 9 aa, Homo Sapiens
SPRNGELQD

SEQ ID NO: 7673 - protein, 9 aa, Homo Sapiens
DFPYKRILG

SEQ ID NO: 7674 - protein, 9 aa, Homo Sapiens
ILGPDFGYV

SEQ ID NO: 7675 - protein, 9 aa, Homo Sapiens
PDFGYVTRE

SEQ ID NO: 7676 - protein, 9 aa, Homo Sapiens
SPPVVANGK

SEQ ID NO: 7677 - protein, 9 aa, Homo Sapiens
ANGKEYPLG

SEQ ID NO: 7678 - protein, 9 aa, Homo Sapiens
PLGRILIGG

SEQ ID NO: 7679 - protein, 9 aa, Homo Sapiens
GNLPGSSGR

SEQ ID NO: 7680 - protein, 9 aa, Homo Sapiens
PGSSGRRVT

SEQ ID NO: 7681 - protein, 9 aa, Homo Sapiens
SGRRVTQVV

SEQ ID NO: 7682 - protein, 9 aa, Homo Sapiens
DFLHAQKVQ

SEQ ID NO: 7683 - protein, 9 aa, Homo Sapiens
MLLASPGAC

SEQ ID NO: 7684 - protein, 9 aa, Homo Sapiens
FKLFQEKQK

SEQ ID NO: 7685 - protein, 9 aa, Homo Sapiens
KLFQEKQKC

SEQ ID NO: 7686 - protein, 9 aa, Homo Sapiens
LLFQGVVDD

SEQ ID NO: 7687 - protein, 9 aa, Homo Sapiens
VVDDEQVKT

SEQ ID NO: 7688 - protein, 9 aa, Homo Sapiens
TISINQVLS

SEQ ID NO: 7689 - protein, 9 aa, Homo Sapiens
NKDLINYNK

SEQ ID NO: 7690 - protein, 9 aa, Homo Sapiens
INYNKFVQS

SEQ ID NO: 7691 - protein, 9 aa, Homo Sapiens
IDWNREVLK

SEQ ID NO: 7692 - protein, 9 aa, Homo Sapiens
DWNREVLKR

SEQ ID NO: 7693 - protein, 9 aa, Homo Sapiens
QLFKTERKK

SEQ ID NO: 7694 - protein, 9 aa, Homo Sapiens
TAFFPDLVN

SEQ ID NO: 7695 - protein, 9 aa, Homo Sapiens
DLVNMLVLG

SEQ ID NO: 7696 - protein, 9 aa, Homo Sapiens
VNMLVLGKH

SEQ ID NO: 7697 - protein, 9 aa, Homo Sapiens
GPIINGCCC

SEQ ID NO: 7698 - protein, 9 aa, Homo Sapiens
CCCLEEKVR

SEQ ID NO: 7699 - protein, 9 aa, Homo Sapiens
SLLEPLGLH

SEQ ID NO: 7700 - protein, 9 aa, Homo Sapiens
LLEPLGLHC

SEQ ID NO: 7701 - protein, 9 aa, Homo Sapiens
DFTPYHMLH

SEQ ID NO: 7702 - protein, 9 aa, Homo Sapiens
RVSLEHPTS

SEQ ID NO: 7703 - protein, 9 aa, Homo Sapiens
SAVCVAGVE

SEQ ID NO: 7704 - protein, 9 aa, Homo Sapiens
VAGVETLVD

SEQ ID NO: 7705 - protein, 9 aa, Homo Sapiens
GSVPEGTEM

SEQ ID NO: 7706 - protein, 9 aa, Homo Sapiens
TPGVDIYIS

SEQ ID NO: 7707 - protein, 9 aa, Homo Sapiens
PGVDIYISP

SEQ ID NO: 7708 - protein, 9 aa, Homo Sapiens
IYISPNMER

SEQ ID NO: 7709 - protein, 9 aa, Homo Sapiens
ISPNMERGR

SEQ ID NO: 7710 - protein, 9 aa, Homo Sapiens
PNMERGRER

SEQ ID NO: 7711 - protein, 9 aa, Homo Sapiens
NMERGRERA

SEQ ID NO: 7712 - protein, 9 aa, Homo Sapiens
RGRERADTR

SEQ ID NO: 7713 - protein, 9 aa, Homo Sapiens
TLEIIVVMN

SEQ ID NO: 7714 - protein, 9 aa, Homo Sapiens
VVMNSPSND

SEQ ID NO: 7715 - protein, 9 aa, Homo Sapiens
DSHVQISYH

SEQ ID NO: 7716 - protein, 9 aa, Homo Sapiens
VQISYHSSH

SEQ ID NO: 7717 - protein, 9 aa, Homo Sapiens
SSHEPLPLA

SEQ ID NO: 7718 - protein, 9 aa, Homo Sapiens
LYLTCVDIS

SEQ ID NO: 7719 - protein, 9 aa, Homo Sapiens
TCVDISLDC

SEQ ID NO: 7720 - protein, 9 aa, Homo Sapiens
DISLDCDLN

SEQ ID NO: 7721 - protein, 9 aa, Homo Sapiens
ISLDCDLNC

SEQ ID NO: 7722 - protein, 9 aa, Homo Sapiens
DCDLNCEGR

SEQ ID NO: 7723 - protein, 9 aa, Homo Sapiens
NCEGRQDRN

SEQ ID NO: 7724 - protein, 9 aa, Homo Sapiens
GRQDRNFVD

SEQ ID NO: 7725 - protein, 9 aa, Homo Sapiens
QDRNFVDKR

SEQ ID NO: 7726 - protein, 9 aa, Homo Sapiens
NFVDKRQWV

SEQ ID NO: 7727 - protein, 9 aa, Homo Sapiens
VWGPSGYGG

SEQ ID NO: 7728 - protein, 9 aa, Homo Sapiens
NCDRDDPSC

SEQ ID NO: 7729 - protein, 9 aa, Homo Sapiens
DDPSCDVQD

SEQ ID NO: 7730 - protein, 9 aa, Homo Sapiens
SCDVQDNCD

SEQ ID NO: 7731 - protein, 9 aa, Homo Sapiens
DVQDNCDQH

SEQ ID NO: 7732 - protein, 9 aa, Homo Sapiens
DMSVMVLRT

SEQ ID NO: 7733 - protein, 9 aa, Homo Sapiens
MSVMVLRTQ

SEQ ID NO: 7734 - protein, 9 aa, Homo Sapiens
VMVLRTQGP

SEQ ID NO: 7735 - protein, 9 aa, Homo Sapiens
VLRTQGPAA

SEQ ID NO: 7736 - protein, 9 aa, Homo Sapiens
KRAQVFHIC

SEQ ID NO: 7737 - protein, 9 aa, Homo Sapiens
QVFHICGPE

SEQ ID NO: 7738 - protein, 9 aa, Homo Sapiens
EDVCEAYRH

SEQ ID NO: 7739 - protein, 9 aa, Homo Sapiens
VSYEVPRLH

SEQ ID NO: 7740 - protein, 9 aa, Homo Sapiens
SYEVPRLHG

SEQ ID NO: 7741 - protein, 9 aa, Homo Sapiens
GDEERFFVE

SEQ ID NO: 7742 - protein, 9 aa, Homo Sapiens
SFHVTLLDD

SEQ ID NO: 7743 - protein, 9 aa, Homo Sapiens
TLLDDSNED

SEQ ID NO: 7744 - protein, 9 aa, Homo Sapiens
DSNEDFSAS

SEQ ID NO: 7745 - protein, 9 aa, Homo Sapiens
DFSASPIFT

SEQ ID NO: 7746 - protein, 9 aa, Homo Sapiens
IFTDTVVFR

SEQ ID NO: 7747 - protein, 9 aa, Homo Sapiens
FTDTVVFRV

SEQ ID NO: 7748 - protein, 9 aa, Homo Sapiens
TDTVVFRVA

SEQ ID NO: 7749 - protein, 9 aa, Homo Sapiens
WIMTPSTLP

SEQ ID NO: 7750 - protein, 9 aa, Homo Sapiens
PSTLPPLEV

SEQ ID NO: 7751 - protein, 9 aa, Homo Sapiens
VYVCRVRNN

SEQ ID NO: 7752 - protein, 9 aa, Homo Sapiens
YVCRVRNNT

SEQ ID NO: 7753 - protein, 9 aa, Homo Sapiens
VCRVRNNTC

SEQ ID NO: 7754 - protein, 9 aa, Homo Sapiens
RVRNNTCFV

SEQ ID NO: 7755 - protein, 9 aa, Homo Sapiens
RNNTCFVDA

SEQ ID NO: 7756 - protein, 9 aa, Homo Sapiens
FVDAVAELA

SEQ ID NO: 7757 - protein, 9 aa, Homo Sapiens
VDAVAELAR

SEQ ID NO: 7758 - protein, 9 aa, Homo Sapiens
LTICPQAEN

SEQ ID NO: 7759 - protein, 9 aa, Homo Sapiens
PQAENRNDR

SEQ ID NO: 7760 - protein, 9 aa, Homo Sapiens
GYVQAPHKT

SEQ ID NO: 7761 - protein, 9 aa, Homo Sapiens
QAPHKTLPV

SEQ ID NO: 7762 - protein, 9 aa, Homo Sapiens
HKTLPVVFD

SEQ ID NO: 7763 - protein, 9 aa, Homo Sapiens
VFDSPRNGE

SEQ ID NO: 7764 - protein, 9 aa, Homo Sapiens
PYKRILGPD

SEQ ID NO: 7765 - protein, 9 aa, Homo Sapiens
LGPDFGYVT

SEQ ID NO: 7766 - protein, 9 aa, Homo Sapiens
GPDFGYVTR

SEQ ID NO: 7767 - protein, 9 aa, Homo Sapiens
YVTREPRDR

SEQ ID NO: 7768 - protein, 9 aa, Homo Sapiens
SVSGLDSFG

SEQ ID NO: 7769 - protein, 9 aa, Homo Sapiens
GLDSFGNLE

SEQ ID NO: 7770 - protein, 9 aa, Homo Sapiens
SFGNLEVSP

SEQ ID NO: 7771 - protein, 9 aa, Homo Sapiens
NLEVSPPVV

SEQ ID NO: 7772 - protein, 9 aa, Homo Sapiens
NGKEYPLGR

SEQ ID NO: 7773 - protein, 9 aa, Homo Sapiens
LGRILIGGN

SEQ ID NO: 7774 - protein, 9 aa, Homo Sapiens
RILIGGNLP

SEQ ID NO: 7775 - protein, 9 aa, Homo Sapiens
LIGGNLPGS

SEQ ID NO: 7776 - protein, 9 aa, Homo Sapiens
NLPGSSGRR

SEQ ID NO: 7777 - protein, 9 aa, Homo Sapiens
RRVTQVVRD

SEQ ID NO: 7778 - protein, 9 aa, Homo Sapiens
QVVRDFLHA

SEQ ID NO: 7779 - protein, 9 aa, Homo Sapiens
QPPVELFVD

SEQ ID NO: 7780 - protein, 9 aa, Homo Sapiens
LFVDWLAVG

SEQ ID NO: 7781 - protein, 9 aa, Homo Sapiens
FVDWLAVGH

SEQ ID NO: 7782 - protein, 9 aa, Homo Sapiens
DWLAVGHVD

SEQ ID NO: 7783 - protein, 9 aa, Homo Sapiens
LSFVPAPDG

SEQ ID NO: 7784 - protein, 9 aa, Homo Sapiens
GKGFRMLLA

SEQ ID NO: 7785 - protein, 9 aa, Homo Sapiens
FRMLLASPG

SEQ ID NO: 7786 - protein, 9 aa, Homo Sapiens
EKQKCGHGR

SEQ ID NO: 7787 - protein, 9 aa, Homo Sapiens
GHGRALLFQ

SEQ ID NO: 7788 - protein, 9 aa, Homo Sapiens
RALLFQGVV

SEQ ID NO: 7789 - protein, 9 aa, Homo Sapiens
QVKTISINQ

SEQ ID NO: 7790 - protein, 9 aa, Homo Sapiens
VLSNKDLIN

SEQ ID NO: 7791 - protein, 9 aa, Homo Sapiens
NKFVQSCID

SEQ ID NO: 7792 - protein, 9 aa, Homo Sapiens
FVQSCIDWN

SEQ ID NO: 7793 - protein, 9 aa, Homo Sapiens
WNREVLKRE

SEQ ID NO: 7794 - protein, 9 aa, Homo Sapiens
VLKRELGLA

SEQ ID NO: 7795 - protein, 9 aa, Homo Sapiens
LKRELGLAE

SEQ ID NO: 7796 - protein, 9 aa, Homo Sapiens
KRELGLAEC

SEQ ID NO: 7797 - protein, 9 aa, Homo Sapiens
KTERKKATA

SEQ ID NO: 7798 - protein, 9 aa, Homo Sapiens
KKATAFFPD

SEQ ID NO: 7799 - protein, 9 aa, Homo Sapiens
FPDLVNMLV

SEQ ID NO: 7800 - protein, 9 aa, Homo Sapiens
MLVLGKHLG

SEQ ID NO: 7801 - protein, 9 aa, Homo Sapiens
PKPFGPIIN

SEQ ID NO: 7802 - protein, 9 aa, Homo Sapiens
VRSLLEPLG

SEQ ID NO: 7803 - protein, 9 aa, Homo Sapiens
CTFIDDFTP

SEQ ID NO: 7804 - protein, 9 aa, Homo Sapiens
FIDDFTPYH

SEQ ID NO: 7805 - protein, 9 aa, Homo Sapiens
YHMLHGEVH

SEQ ID NO: 7806 - protein, 9 aa, Homo Sapiens
MLHGEVHCG

SEQ ID NO: 7807 - protein, 9 aa, Homo Sapiens
HCGTNVCRK

SEQ ID NO: 7808 - protein, 9 aa, Homo Sapiens
CGTNVCRKP

SEQ ID NO: 7809 - protein, 9 aa, Homo Sapiens
KPFSFKWWN

SEQ ID NO: 7810 - protein, 9 aa, Homo Sapiens
FSFKWWNMV

SEQ ID NO: 7811 - protein, 9 aa, Homo Sapiens
RIVRVSLEH

SEQ ID NO: 7812 - protein, 9 aa, Homo Sapiens
VSLEHPTSA

SEQ ID NO: 7813 - protein, 9 aa, Homo Sapiens
HPTSAVCVA

SEQ ID NO: 7814 - protein, 9 aa, Homo Sapiens
CVAGVETLV

SEQ ID NO: 7815 - protein, 9 aa, Homo Sapiens
TLVDIYGSV

SEQ ID NO: 7816 - protein, 9 aa, Homo Sapiens
LVDIYGSVP

SEQ ID NO: 7817 - protein, 9 aa, Homo Sapiens
DIYGSVPEG

SEQ ID NO: 7818 - protein, 9 aa, Homo Sapiens
YGSVPEGTE

SEQ ID NO: 7819 - protein, 9 aa, Homo Sapiens
DIYISPNME

SEQ ID NO: 7820 - protein, 9 aa, Homo Sapiens
SPNMERGRE

SEQ ID NO: 7821 - protein, 9 aa, Homo Sapiens
DTRRWRFDA

SEQ ID NO: 7822 - protein, 9 aa, Homo Sapiens
RWRFDATLE

SEQ ID NO: 7823 - protein, 9 aa, Homo Sapiens
FDATLEIIV

SEQ ID NO: 7824 - protein, 9 aa, Homo Sapiens
LNDSHVQIS

SEQ ID NO: 7825 - protein, 9 aa, Homo Sapiens
SHVQISYHS

SEQ ID NO: 7826 - protein, 9 aa, Homo Sapiens
YHSSHEPLP

SEQ ID NO: 7827 - protein, 9 aa, Homo Sapiens
LAYAVLYLT

SEQ ID NO: 7828 - protein, 9 aa, Homo Sapiens
YAVLYLTCV

SEQ ID NO: 7829 - protein, 9 aa, Homo Sapiens
CVDISLDCD

SEQ ID NO: 7830 - protein, 9 aa, Homo Sapiens
CDLNCEGRQ

SEQ ID NO: 7831 - protein, 9 aa, Homo Sapiens
DLNCEGRQD

SEQ ID NO: 7832 - protein, 9 aa, Homo Sapiens
DRNFVDKRQ

SEQ ID NO: 7833 - protein, 9 aa, Homo Sapiens
VDKRQWVWG

SEQ ID NO: 7834 - protein, 9 aa, Homo Sapiens
YGGILLVNC

SEQ ID NO: 7835 - protein, 9 aa, Homo Sapiens
GILLVNCDR

SEQ ID NO: 7836 - protein, 9 aa, Homo Sapiens
ILLVNCDRD

SEQ ID NO: 7837 - protein, 9 aa, Homo Sapiens
LLVNCDRDD

SEQ ID NO: 7838 - protein, 9 aa, Homo Sapiens
VNCDRDDPS

SEQ ID NO: 7839 - protein, 9 aa, Homo Sapiens
CDRDDPSCD

SEQ ID NO: 7840 - protein, 9 aa, Homo Sapiens
DRDDPSCDV

SEQ ID NO: 7841 - protein, 9 aa, Homo Sapiens
DPSCDVQDN

SEQ ID NO: 7842 - protein, 9 aa, Homo Sapiens
VQDNCDQHV

SEQ ID NO: 7843 - protein, 9 aa, Homo Sapiens
QDNCDQHVH

SEQ ID NO: 7844 - protein, 9 aa, Homo Sapiens
DNCDQHVHC

SEQ ID NO: 7845 - protein, 9 aa, Homo Sapiens
DQHVHCLQD

SEQ ID NO: 7846 - protein, 9 aa, Homo Sapiens
VHCLQDLED

SEQ ID NO: 7847 - protein, 9 aa, Homo Sapiens
HCLQDLEDM

SEQ ID NO: 7848 - protein, 9 aa, Homo Sapiens
LQDLEDMSV

SEQ ID NO: 7849 - protein, 9 aa, Homo Sapiens
QDLEDMSVM

SEQ ID NO: 7850 - protein, 9 aa, Homo Sapiens
DLEDMSVMV

SEQ ID NO: 7851 - protein, 9 aa, Homo Sapiens
MVLRTQGPA

SEQ ID NO: 7852 - protein, 9 aa, Homo Sapiens
QGPAALFDD

SEQ ID NO: 7853 - protein, 9 aa, Homo Sapiens
DDHKLVLHT

SEQ ID NO: 7854 - protein, 9 aa, Homo Sapiens
LHTSSYDAK

SEQ ID NO: 7855 - protein, 9 aa, Homo Sapiens
HTSSYDAKR

SEQ ID NO: 7856 - protein, 9 aa, Homo Sapiens
DAKRAQVFH

SEQ ID NO: 7857 - protein, 9 aa, Homo Sapiens
HICGPEDVC

SEQ ID NO: 7858 - protein, 9 aa, Homo Sapiens
CGPEDVCEA

SEQ ID NO: 7859 - protein, 9 aa, Homo Sapiens
RHVLGQDKV

SEQ ID NO: 7860 - protein, 9 aa, Homo Sapiens
LGQDKVSYE

SEQ ID NO: 7861 - protein, 9 aa, Homo Sapiens
HGDEERFFV

SEQ ID NO: 7862 - protein, 9 aa, Homo Sapiens
FTGLISFHV

SEQ ID NO: 7863 - protein, 9 aa, Homo Sapiens
FHVTLLDDS

SEQ ID NO: 7864 - protein, 9 aa, Homo Sapiens
VTLLDDSNE

SEQ ID NO: 7865 - protein, 9 aa, Homo Sapiens
LDDSNEDFS

SEQ ID NO: 7866 - protein, 9 aa, Homo Sapiens
DDSNEDFSA

SEQ ID NO: 7867 - protein, 9 aa, Homo Sapiens
SNEDFSASP

SEQ ID NO: 7868 - protein, 9 aa, Homo Sapiens
VAPWIMTPS

SEQ ID NO: 7869 - protein, 9 aa, Homo Sapiens
PPLEVYVCR

SEQ ID NO: 7870 - protein, 9 aa, Homo Sapiens
VRNNTCFVD

SEQ ID NO: 7871 - protein, 9 aa, Homo Sapiens
NTCFVDAVA

SEQ ID NO: 7872 - protein, 9 aa, Homo Sapiens
KAGCKLTIC

SEQ ID NO: 7873 - protein, 9 aa, Homo Sapiens
ICPQAENRN

SEQ ID NO: 7874 - protein, 9 aa, Homo Sapiens
NDRWIQDEM

SEQ ID NO: 7875 - protein, 9 aa, Homo Sapiens
WIQDEMELG

SEQ ID NO: 7876 - protein, 9 aa, Homo Sapiens
ELGYVQAPH

SEQ ID NO: 7877 - protein, 9 aa, Homo Sapiens
TLPVVFDSP

SEQ ID NO: 7878 - protein, 9 aa, Homo Sapiens
DFGYVTREP

SEQ ID NO: 7879 - protein, 9 aa, Homo Sapiens
GYVTREPRD

SEQ ID NO: 7880 - protein, 9 aa, Homo Sapiens
DRSVSGLDS

SEQ ID NO: 7881 - protein, 9 aa, Homo Sapiens
LDSFGNLEV

SEQ ID NO: 7882 - protein, 9 aa, Homo Sapiens
FGNLEVSPP

SEQ ID NO: 7883 - protein, 9 aa, Homo Sapiens
IGGNLPGSS

SEQ ID NO: 7884 - protein, 9 aa, Homo Sapiens
GRRVTQVVR

SEQ ID NO: 7885 - protein, 9 aa, Homo Sapiens
TQVVRDFLH

SEQ ID NO: 7886 - protein, 9 aa, Homo Sapiens
VRDFLHAQK

SEQ ID NO: 7887 - protein, 9 aa, Homo Sapiens
FLHAQKVQP

SEQ ID NO: 7888 - protein, 9 aa, Homo Sapiens
VDWLAVGHV

SEQ ID NO: 7889 - protein, 9 aa, Homo Sapiens
HVDEFLSFV

SEQ ID NO: 7890 - protein, 9 aa, Homo Sapiens
FLSFVPAPD

SEQ ID NO: 7891 - protein, 9 aa, Homo Sapiens
FVPAPDGKG

SEQ ID NO: 7892 - protein, 9 aa, Homo Sapiens
PAPDGKGFR

SEQ ID NO: 7893 - protein, 9 aa, Homo Sapiens
RMLLASPGA

SEQ ID NO: 7894 - protein, 9 aa, Homo Sapiens
GACFKLFQE

SEQ ID NO: 7895 - protein, 9 aa, Homo Sapiens
CFKLFQEKQ

SEQ ID NO: 7896 - protein, 9 aa, Homo Sapiens
LFQEKQKCG

SEQ ID NO: 7897 - protein, 9 aa, Homo Sapiens
HGRALLFQG

SEQ ID NO: 7898 - protein, 9 aa, Homo Sapiens
GRALLFQGV

SEQ ID NO: 7899 - protein, 9 aa, Homo Sapiens
LFQGVVDDE

SEQ ID NO: 7900 - protein, 9 aa, Homo Sapiens
GVVDDEQVK

SEQ ID NO: 7901 - protein, 9 aa, Homo Sapiens
SINQVLSNK

SEQ ID NO: 7902 - protein, 9 aa, Homo Sapiens
INQVLSNKD

SEQ ID NO: 7903 - protein, 9 aa, Homo Sapiens
LINYNKFVQ

SEQ ID NO: 7904 - protein, 9 aa, Homo Sapiens
NYNKFVQSC

SEQ ID NO: 7905 - protein, 9 aa, Homo Sapiens
VQSCIDWNR

SEQ ID NO: 7906 - protein, 9 aa, Homo Sapiens
IIDIPQLFK

SEQ ID NO: 7907 - protein, 9 aa, Homo Sapiens
PQLFKTERK

SEQ ID NO: 7908 - protein, 9 aa, Homo Sapiens
LVNMLVLGK

SEQ ID NO: 7909 - protein, 9 aa, Homo Sapiens
FGPIINGCC

SEQ ID NO: 7910 - protein, 9 aa, Homo Sapiens
IINGCCCLE

SEQ ID NO: 7911 - protein, 9 aa, Homo Sapiens
NGCCCLEEK

SEQ ID NO: 7912 - protein, 9 aa, Homo Sapiens
CCLEEKVRS

SEQ ID NO: 7913 - protein, 9 aa, Homo Sapiens
LGLHCTFID

SEQ ID NO: 7914 - protein, 9 aa, Homo Sapiens
GLHCTFIDD

SEQ ID NO: 7915 - protein, 9 aa, Homo Sapiens
IDDFTPYHM

SEQ ID NO: 7916 - protein, 9 aa, Homo Sapiens
FTPYHMLHG

SEQ ID NO: 7917 - protein, 9 aa, Homo Sapiens
TPYHMLHGE

SEQ ID NO: 7918 - protein, 9 aa, Homo Sapiens
HMLHGEVHC

SEQ ID NO: 7919 - protein, 9 aa, Homo Sapiens
VHCGTNVCR

SEQ ID NO: 7920 - protein, 9 aa, Homo Sapiens
SFKWWNMVP

SEQ ID NO: 7921 - protein, 9 aa, Homo Sapiens
IVRVSLEHP

SEQ ID NO: 7922 - protein, 9 aa, Homo Sapiens
VRVSLEHPT

SEQ ID NO: 7923 - protein, 9 aa, Homo Sapiens
TSAVCVAGV

SEQ ID NO: 7924 - protein, 9 aa, Homo Sapiens
IYGSVPEGT

SEQ ID NO: 7925 - protein, 9 aa, Homo Sapiens
VPEGTEMFE

SEQ ID NO: 7926 - protein, 9 aa, Homo Sapiens
GTEMFEVYG

SEQ ID NO: 7927 - protein, 9 aa, Homo Sapiens
GRERADTRR

SEQ ID NO: 7928 - protein, 9 aa, Homo Sapiens
IVVMNSPSN

SEQ ID NO: 7929 - protein, 9 aa, Homo Sapiens
PSNDLNDSH

SEQ ID NO: 7930 - protein, 9 aa, Homo Sapiens
HVQISYHSS

SEQ ID NO: 7931 - protein, 9 aa, Homo Sapiens
QISYHSSHE

SEQ ID NO: 7932 - protein, 9 aa, Homo Sapiens
ISYHSSHEP

SEQ ID NO: 7933 - protein, 9 aa, Homo Sapiens
LDCDLNCEG

SEQ ID NO: 7934 - protein, 9 aa, Homo Sapiens
LNCEGRQDR

SEQ ID NO: 7935 - protein, 9 aa, Homo Sapiens
DKRQWVWGP

SEQ ID NO: 7936 - protein, 9 aa, Homo Sapiens
KRQWVWGPS

SEQ ID NO: 7937 - protein, 9 aa, Homo Sapiens
WVWGPSGYG

SEQ ID NO: 7938 - protein, 9 aa, Homo Sapiens
LVNCDRDDP

SEQ ID NO: 7939 - protein, 9 aa, Homo Sapiens
PSCDVQDNC

SEQ ID NO: 7940 - protein, 9 aa, Homo Sapiens
CDQHVHCLQ

SEQ ID NO: 7941 - protein, 9 aa, Homo Sapiens
HVHCLQDLE

SEQ ID NO: 7942 - protein, 9 aa, Homo Sapiens
CLQDLEDMS

SEQ ID NO: 7943 - protein, 9 aa, Homo Sapiens
GPAALFDDH

SEQ ID NO: 7944 - protein, 9 aa, Homo Sapiens
PAALFDDHK

SEQ ID NO: 7945 - protein, 9 aa, Homo Sapiens
HKLVLHTSS

SEQ ID NO: 7946 - protein, 9 aa, Homo Sapiens
LVLHTSSYD

SEQ ID NO: 7947 - protein, 9 aa, Homo Sapiens
VLHTSSYDA

SEQ ID NO: 7948 - protein, 9 aa, Homo Sapiens
RAQVFHICG

SEQ ID NO: 7949 - protein, 9 aa, Homo Sapiens
DVCEAYRHV

SEQ ID NO: 7950 - protein, 9 aa, Homo Sapiens
GQDKVSYEV

SEQ ID NO: 7951 - protein, 9 aa, Homo Sapiens
QDKVSYEVP

SEQ ID NO: 7952 - protein, 9 aa, Homo Sapiens
DKVSYEVPR

SEQ ID NO: 7953 - protein, 9 aa, Homo Sapiens
VPRLHGDEE

SEQ ID NO: 7954 - protein, 9 aa, Homo Sapiens
PRLHGDEER

SEQ ID NO: 7955 - protein, 9 aa, Homo Sapiens
FFVEGLSFP

SEQ ID NO: 7956 - protein, 9 aa, Homo Sapiens
FVEGLSFPD

SEQ ID NO: 7957 - protein, 9 aa, Homo Sapiens
DAGFTGLIS

SEQ ID NO: 7958 - protein, 9 aa, Homo Sapiens
HVTLLDDSN

SEQ ID NO: 7959 - protein, 9 aa, Homo Sapiens
VFRVAPWIM

SEQ ID NO: 7960 - protein, 9 aa, Homo Sapiens
FRVAPWIMT

SEQ ID NO: 7961 - protein, 9 aa, Homo Sapiens
PLEVYVCRV

SEQ ID NO: 7962 - protein, 9 aa, Homo Sapiens
DAVAELARK

SEQ ID NO: 7963 - protein, 9 aa, Homo Sapiens
CPQAENRND

SEQ ID NO: 7964 - protein, 9 aa, Homo Sapiens
QDEMELGYV

SEQ ID NO: 7965 - protein, 9 aa, Homo Sapiens
LGYVQAPHK

SEQ ID NO: 7966 - protein, 9 aa, Homo Sapiens
FGYVTREPR

SEQ ID NO: 7967 - protein, 9 aa, Homo Sapiens
VTREPRDRS

SEQ ID NO: 7968 - protein, 9 aa, Homo Sapiens
RDRSVSGLD

SEQ ID NO: 7969 - protein, 9 aa, Homo Sapiens
VSGLDSFGN

SEQ ID NO: 7970 - protein, 9 aa, Homo Sapiens
GNLEVSPPV

SEQ ID NO: 7971 - protein, 9 aa, Homo Sapiens
PPVVANGKE

SEQ ID NO: 7972 - protein, 9 aa, Homo Sapiens
VVANGKEYP

SEQ ID NO: 7973 - protein, 9 aa, Homo Sapiens
GGNLPGSSG

SEQ ID NO: 7974 - protein, 9 aa, Homo Sapiens
LPGSSGRRV

SEQ ID NO: 7975 - protein, 9 aa, Homo Sapiens
LHAQKVQPP

SEQ ID NO: 7976 - protein, 9 aa, Homo Sapiens
WLAVGHVDE

SEQ ID NO: 7977 - protein, 9 aa, Homo Sapiens
VGHVDEFLS

SEQ ID NO: 7978 - protein, 9 aa, Homo Sapiens
VDEFLSFVP

SEQ ID NO: 7979 - protein, 9 aa, Homo Sapiens
GFRMLLASP

SEQ ID NO: 7980 - protein, 9 aa, Homo Sapiens
PGACFKLFQ

SEQ ID NO: 7981 - protein, 9 aa, Homo Sapiens
KQKCGHGRA

SEQ ID NO: 7982 - protein, 9 aa, Homo Sapiens
QGVVDDEQV

SEQ ID NO: 7983 - protein, 9 aa, Homo Sapiens
QSCIDWNRE

SEQ ID NO: 7984 - protein, 9 aa, Homo Sapiens
GLAECDIID

SEQ ID NO: 7985 - protein, 9 aa, Homo Sapiens
IPQLFKTER

SEQ ID NO: 7986 - protein, 9 aa, Homo Sapiens
RKKATAFFP

SEQ ID NO: 7987 - protein, 9 aa, Homo Sapiens
VLGKHLGIP

SEQ ID NO: 7988 - protein, 9 aa, Homo Sapiens
LGKHLGIPK

SEQ ID NO: 7989 - protein, 9 aa, Homo Sapiens
INGCCCLEE

SEQ ID NO: 7990 - protein, 9 aa, Homo Sapiens
GCCCLEEKV

SEQ ID NO: 7991 - protein, 9 aa, Homo Sapiens
HCTFIDDFT

SEQ ID NO: 7992 - protein, 9 aa, Homo Sapiens
HGEVHCGTN

SEQ ID NO: 7993 - protein, 9 aa, Homo Sapiens
TNVCRKPFS

SEQ ID NO: 7994 - protein, 9 aa, Homo Sapiens
VCRKPFSFK

SEQ ID NO: 7995 - protein, 9 aa, Homo Sapiens
PFSFKWWNM

SEQ ID NO: 7996 - protein, 9 aa, Homo Sapiens
STLAPLEVY

SEQ ID NO: 7997 - protein, 9 aa, Homo Sapiens
MTPSTLAPL

SEQ ID NO: 7998 - protein, 9 aa, Homo Sapiens
IMTPSTLAP

SEQ ID NO: 7999 - protein, 9 aa, Homo Sapiens
APLEVYVCR

SEQ ID NO: 8000 - protein, 9 aa, Homo Sapiens
TPSTLAPLE

SEQ ID NO: 8001 - protein, 9 aa, Homo Sapiens
TLAPLEVYV

SEQ ID NO: 8002 - protein, 9 aa, Homo Sapiens
LAPLEVYVC

SEQ ID NO: 8003 - protein, 9 aa, Homo Sapiens
WIMTPSTLA

SEQ ID NO: 8004 - protein, 9 aa, Homo Sapiens
PSTLAPLEV

SEQ ID NO: 8005 - protein, 9 aa, Homo Sapiens
DEFLSFVPV

SEQ ID NO: 8006 - protein, 9 aa, Homo Sapiens
VPVPDGKGF

SEQ ID NO: 8007 - protein, 9 aa, Homo Sapiens
EFLSFVPVP

SEQ ID NO: 8008 - protein, 9 aa, Homo Sapiens
SFVPVPDGK

SEQ ID NO: 8009 - protein, 9 aa, Homo Sapiens
FLSFVPVPD

SEQ ID NO: 8010 - protein, 9 aa, Homo Sapiens
LSFVPVPDG

SEQ ID NO: 8011 - protein, 9 aa, Homo Sapiens
FVPVPDGKG

SEQ ID NO: 8012 - protein, 9 aa, Homo Sapiens
PVPDGKGFR

SEQ ID NO: 8013 - protein, 9 aa, Homo Sapiens
VPDGKGFRM

SEQ ID NO: 8014 - protein, 9 aa, Homo Sapiens
DATLEIIVV

SEQ ID NO: 8015 - protein, 9 aa, Homo Sapiens
APHKTLPVV

SEQ ID NO: 8016 - protein, 9 aa, Homo Sapiens
LAECDIIDI

SEQ ID NO: 8017 - protein, 9 aa, Homo Sapiens
YAVLYLTCV

SEQ ID NO: 8018 - protein, 9 aa, Homo Sapiens
SPIFTDTVV

SEQ ID NO: 8019 - protein, 9 aa, Homo Sapiens
LPGSSGRRV

SEQ ID NO: 8020 - protein, 9 aa, Homo Sapiens
RALLFQGVV

SEQ ID NO: 8021 - protein, 9 aa, Homo Sapiens
FPDLVNMLV

SEQ ID NO: 8022 - protein, 9 aa, Homo Sapiens
IPKPFGPII

SEQ ID NO: 8023 - protein, 9 aa, Homo Sapiens
AGVETLVDI

SEQ ID NO: 8024 - protein, 9 aa, Homo Sapiens
EPLPLAYAV

SEQ ID NO: 8025 - protein, 9 aa, Homo Sapiens
SGYGGILLV

SEQ ID NO: 8026 - protein, 9 aa, Homo Sapiens
LARKAGCKL

SEQ ID NO: 8027 - protein, 9 aa, Homo Sapiens
QAPHKTLPV

SEQ ID NO: 8028 - protein, 9 aa, Homo Sapiens
HAQKVQPPV

SEQ ID NO: 8029 - protein, 9 aa, Homo Sapiens
LGLAECDII

SEQ ID NO: 8030 - protein, 9 aa, Homo Sapiens
LAYAVLYLT

SEQ ID NO: 8031 - protein, 9 aa, Homo Sapiens
AALFDDHKL

SEQ ID NO: 8032 - protein, 9 aa, Homo Sapiens
FPDAGFTGL

SEQ ID NO: 8033 - protein, 9 aa, Homo Sapiens
VANGKEYPL

SEQ ID NO: 8034 - protein, 9 aa, Homo Sapiens
SGRRVTQVV

SEQ ID NO: 8035 - protein, 9 aa, Homo Sapiens
LPLAYAVLY

SEQ ID NO: 8036 - protein, 9 aa, Homo Sapiens
GPSGYGGIL

SEQ ID NO: 8037 - protein, 9 aa, Homo Sapiens
LPPLEVYVC

SEQ ID NO: 8038 - protein, 9 aa, Homo Sapiens
FPYKRILGP

SEQ ID NO: 8039 - protein, 9 aa, Homo Sapiens
VDDEQVKTI

SEQ ID NO: 8040 - protein, 9 aa, Homo Sapiens
KATAFFPDL

SEQ ID NO: 8041 - protein, 9 aa, Homo Sapiens
DLNDSHVQI

SEQ ID NO: 8042 - protein, 9 aa, Homo Sapiens
VLYLTCVDI

SEQ ID NO: 8043 - protein, 9 aa, Homo Sapiens
WGPSGYGGI

SEQ ID NO: 8044 - protein, 9 aa, Homo Sapiens
EAYRHVLGQ

SEQ ID NO: 8045 - protein, 9 aa, Homo Sapiens
PPLEVYVCR

SEQ ID NO: 8046 - protein, 9 aa, Homo Sapiens
DAVAELARK

SEQ ID NO: 8047 - protein, 9 aa, Homo Sapiens
SGLDSFGNL

SEQ ID NO: 8048 - protein, 9 aa, Homo Sapiens
YPLGRILIG

SEQ ID NO: 8049 - protein, 9 aa, Homo Sapiens
DGKGFRMLL

SEQ ID NO: 8050 - protein, 9 aa, Homo Sapiens
LVLGKHLGI

SEQ ID NO: 8051 - protein, 9 aa, Homo Sapiens
TPYHMLHGE

SEQ ID NO: 8052 - protein, 9 aa, Homo Sapiens
SAVCVAGVE

SEQ ID NO: 8053 - protein, 9 aa, Homo Sapiens
DPSCDVQDN

SEQ ID NO: 8054 - protein, 9 aa, Homo Sapiens
DVCEAYRHV

SEQ ID NO: 8055 - protein, 9 aa, Homo Sapiens
HGDEERFFV

SEQ ID NO: 8056 - protein, 9 aa, Homo Sapiens
DAGFTGLIS

SEQ ID NO: 8057 - protein, 9 aa, Homo Sapiens
DEQVKTISI

SEQ ID NO: 8058 - protein, 9 aa, Homo Sapiens
TAFFPDLVN

SEQ ID NO: 8059 - protein, 9 aa, Homo Sapiens
HPTSAVCVA

SEQ ID NO: 8060 - protein, 9 aa, Homo Sapiens
VAGVETLVD

SEQ ID NO: 8061 - protein, 9 aa, Homo Sapiens
GTPGVDIYI

SEQ ID NO: 8062 - protein, 9 aa, Homo Sapiens
EGRQDRNFV

SEQ ID NO: 8063 - protein, 9 aa, Homo Sapiens
DLEDMSVMV

SEQ ID NO: 8064 - protein, 9 aa, Homo Sapiens
DAKRAQVFH

SEQ ID NO: 8065 - protein, 9 aa, Homo Sapiens
FTDTVVFRV

SEQ ID NO: 8066 - protein, 9 aa, Homo Sapiens
VVFRVAPWI

SEQ ID NO: 8067 - protein, 9 aa, Homo Sapiens
SPPVVANGK

SEQ ID NO: 8068 - protein, 9 aa, Homo Sapiens
QPPVELFVD

SEQ ID NO: 8069 - protein, 9 aa, Homo Sapiens
LAVGHVDEF

SEQ ID NO: 8070 - protein, 9 aa, Homo Sapiens
DLINYNKFV

SEQ ID NO: 8071 - protein, 9 aa, Homo Sapiens
EPLGLHCTF

SEQ ID NO: 8072 - protein, 9 aa, Homo Sapiens
MSLQRIVRV

SEQ ID NO: 8073 - protein, 9 aa, Homo Sapiens
LEDMSVMVL

SEQ ID NO: 8074 - protein, 9 aa, Homo Sapiens
AKRAQVFHI

SEQ ID NO: 8075 - protein, 9 aa, Homo Sapiens
TGLISFHVT

SEQ ID NO: 8076 - protein, 9 aa, Homo Sapiens
RKAGCKLTI

SEQ ID NO: 8077 - protein, 9 aa, Homo Sapiens
LGYVQAPHK

SEQ ID NO: 8078 - protein, 9 aa, Homo Sapiens
LQDFPYKRI

SEQ ID NO: 8079 - protein, 9 aa, Homo Sapiens
GNLEVSPPV

SEQ ID NO: 8080 - protein, 9 aa, Homo Sapiens
NLEVSPPVV

SEQ ID NO: 8081 - protein, 9 aa, Homo Sapiens
PPVELFVDW

SEQ ID NO: 8082 - protein, 9 aa, Homo Sapiens
QGVVDDEQV

SEQ ID NO: 8083 - protein, 9 aa, Homo Sapiens
YNKFVQSCI

SEQ ID NO: 8084 - protein, 9 aa, Homo Sapiens
KPFGPIING

SEQ ID NO: 8085 - protein, 9 aa, Homo Sapiens
EHPTSAVCV

SEQ ID NO: 8086 - protein, 9 aa, Homo Sapiens
VPEGTEMFE

SEQ ID NO: 8087 - protein, 9 aa, Homo Sapiens
EGTEMFEVY

SEQ ID NO: 8088 - protein, 9 aa, Homo Sapiens
VYGTPGVDI

SEQ ID NO: 8089 - protein, 9 aa, Homo Sapiens
WRFDATLEI

SEQ ID NO: 8090 - protein, 9 aa, Homo Sapiens
RFDATLEII

SEQ ID NO: 8091 - protein, 9 aa, Homo Sapiens
DRDDPSCDV

SEQ ID NO: 8092 - protein, 9 aa, Homo Sapiens
LFDDHKLVL

SEQ ID NO: 8093 - protein, 9 aa, Homo Sapiens
GPEDVCEAY

SEQ ID NO: 8094 - protein, 9 aa, Homo Sapiens
NEDFSASPI

SEQ ID NO: 8095 - protein, 9 aa, Homo Sapiens
VAPWIMTPS

SEQ ID NO: 8096 - protein, 9 aa, Homo Sapiens
TPSTLPPLE

SEQ ID NO: 8097 - protein, 9 aa, Homo Sapiens
KAGCKLTIC

SEQ ID NO: 8098 - protein, 9 aa, Homo Sapiens
CPQAENRND

SEQ ID NO: 8099 - protein, 9 aa, Homo Sapiens
LGPDFGYVT

SEQ ID NO: 8100 - protein, 9 aa, Homo Sapiens
GPDFGYVTR

SEQ ID NO: 8101 - protein, 9 aa, Homo Sapiens
PPVVANGKE

SEQ ID NO: 8102 - protein, 9 aa, Homo Sapiens
VQPPVELFV

SEQ ID NO: 8103 - protein, 9 aa, Homo Sapiens
VDWLAVGHV

SEQ ID NO: 8104 - protein, 9 aa, Homo Sapiens
APDGKGFRM

SEQ ID NO: 8105 - protein, 9 aa, Homo Sapiens
LASPGACFK

SEQ ID NO: 8106 - protein, 9 aa, Homo Sapiens
SPGACFKLF

SEQ ID NO: 8107 - protein, 9 aa, Homo Sapiens
IPQLFKTER

SEQ ID NO: 8108 - protein, 9 aa, Homo Sapiens
GIPKPFGPI

SEQ ID NO: 8109 - protein, 9 aa, Homo Sapiens
VCVAGVETL

SEQ ID NO: 8110 - protein, 9 aa, Homo Sapiens
CVAGVETLV

SEQ ID NO: 8111 - protein, 9 aa, Homo Sapiens
DIYGSVPEG

SEQ ID NO: 8112 - protein, 9 aa, Homo Sapiens
TPGVDIYIS

SEQ ID NO: 8113 - protein, 9 aa, Homo Sapiens
RADTRRWRF

SEQ ID NO: 8114 - protein, 9 aa, Homo Sapiens
SPSNDLNDS

SEQ ID NO: 8115 - protein, 9 aa, Homo Sapiens
GPAALFDDH

SEQ ID NO: 8116 - protein, 9 aa, Homo Sapiens
VCEAYRHVL

SEQ ID NO: 8117 - protein, 9 aa, Homo Sapiens
LGQDKVSYE

SEQ ID NO: 8118 - protein, 9 aa, Homo Sapiens
SASPIFTDT

SEQ ID NO: 8119 - protein, 9 aa, Homo Sapiens
APWIMTPST

SEQ ID NO: 8120 - protein, 9 aa, Homo Sapiens
PLEVYVCRV

SEQ ID NO: 8121 - protein, 9 aa, Homo Sapiens
VAELARKAG

SEQ ID NO: 8122 - protein, 9 aa, Homo Sapiens
QAENRNDRW

SEQ ID NO: 8123 - protein, 9 aa, Homo Sapiens
YVQAPHKTL

SEQ ID NO: 8124 - protein, 9 aa, Homo Sapiens
LPVVFDSPR

SEQ ID NO: 8125 - protein, 9 aa, Homo Sapiens
FGYVTREPR

SEQ ID NO: 8126 - protein, 9 aa, Homo Sapiens
EPRDRSVSG

SEQ ID NO: 8127 - protein, 9 aa, Homo Sapiens
LDSFGNLEV

SEQ ID NO: 8128 - protein, 9 aa, Homo Sapiens
NGKEYPLGR

SEQ ID NO: 8129 - protein, 9 aa, Homo Sapiens
GKEYPLGRI

SEQ ID NO: 8130 - protein, 9 aa, Homo Sapiens
EYPLGRILI

SEQ ID NO: 8131 - protein, 9 aa, Homo Sapiens
RDFLHAQKV

SEQ ID NO: 8132 - protein, 9 aa, Homo Sapiens
DWLAVGHVD

SEQ ID NO: 8133 - protein, 9 aa, Homo Sapiens
VPAPDGKGF

SEQ ID NO: 8134 - protein, 9 aa, Homo Sapiens
PAPDGKGFR

SEQ ID NO: 8135 - protein, 9 aa, Homo Sapiens
GACFKLFQE

SEQ ID NO: 8136 - protein, 9 aa, Homo Sapiens
VKTISINQV

SEQ ID NO: 8137 - protein, 9 aa, Homo Sapiens
QVLSNKDLI

SEQ ID NO: 8138 - protein, 9 aa, Homo Sapiens
FFPDLVNML

SEQ ID NO: 8139 - protein, 9 aa, Homo Sapiens
PDLVNMLVL

SEQ ID NO: 8140 - protein, 9 aa, Homo Sapiens
CLEEKVRSL

SEQ ID NO: 8141 - protein, 9 aa, Homo Sapiens
DDFTPYHML

SEQ ID NO: 8142 - protein, 9 aa, Homo Sapiens
FSFKWWNMV

SEQ ID NO: 8143 - protein, 9 aa, Homo Sapiens
LQRIVRVSL

SEQ ID NO: 8144 - protein, 9 aa, Homo Sapiens
TSAVCVAGV

SEQ ID NO: 8145 - protein, 9 aa, Homo Sapiens
DIYISPNME

SEQ ID NO: 8146 - protein, 9 aa, Homo Sapiens
SPNMERGRE

SEQ ID NO: 8147 - protein, 9 aa, Homo Sapiens
RGRERADTR

SEQ ID NO: 8148 - protein, 9 aa, Homo Sapiens
FDATLEIIV

SEQ ID NO: 8149 - protein, 9 aa, Homo Sapiens
YLTCVDISL

SEQ ID NO: 8150 - protein, 9 aa, Homo Sapiens
NFVDKRQWV

SEQ ID NO: 8151 - protein, 9 aa, Homo Sapiens
PAALFDDHK

SEQ ID NO: 8152 - protein, 9 aa, Homo Sapiens
ALFDDHKLV

SEQ ID NO: 8153 - protein, 9 aa, Homo Sapiens
RAQVFHICG

SEQ ID NO: 8154 - protein, 9 aa, Homo Sapiens
CGPEDVCEA

SEQ ID NO: 8155 - protein, 9 aa, Homo Sapiens
GQDKVSYEV

SEQ ID NO: 8156 - protein, 9 aa, Homo Sapiens
VSYEVPRLH

SEQ ID NO: 8157 - protein, 9 aa, Homo Sapiens
VPRLHGDEE

SEQ ID NO: 8158 - protein, 9 aa, Homo Sapiens
PDAGFTGLI

SEQ ID NO: 8159 - protein, 9 aa, Homo Sapiens
LISFHVTLL

SEQ ID NO: 8160 - protein, 9 aa, Homo Sapiens
ASPIFTDTV

SEQ ID NO: 8161 - protein, 9 aa, Homo Sapiens
TLPPLEVYV

SEQ ID NO: 8162 - protein, 9 aa, Homo Sapiens
NNTCFVDAV

SEQ ID NO: 8163 - protein, 9 aa, Homo Sapiens
AENRNDRWI

SEQ ID NO: 8164 - protein, 9 aa, Homo Sapiens
SPRNGELQD

SEQ ID NO: 8165 - protein, 9 aa, Homo Sapiens
ILGPDFGYV

SEQ ID NO: 8166 - protein, 9 aa, Homo Sapiens
KEYPLGRIL

SEQ ID NO: 8167 - protein, 9 aa, Homo Sapiens
SSGRRVTQV

SEQ ID NO: 8168 - protein, 9 aa, Homo Sapiens
HVDEFLSFV

SEQ ID NO: 8169 - protein, 9 aa, Homo Sapiens
SCIDWNREV

SEQ ID NO: 8170 - protein, 9 aa, Homo Sapiens
NMLVLGKHL

SEQ ID NO: 8171 - protein, 9 aa, Homo Sapiens
LEEKVRSLL

SEQ ID NO: 8172 - protein, 9 aa, Homo Sapiens
PLGLHCTFI

SEQ ID NO: 8173 - protein, 9 aa, Homo Sapiens
CGTNVCRKP

SEQ ID NO: 8174 - protein, 9 aa, Homo Sapiens
KPFSFKWWN

SEQ ID NO: 8175 - protein, 9 aa, Homo Sapiens
TLVDIYGSV

SEQ ID NO: 8176 - protein, 9 aa, Homo Sapiens
YGSVPEGTE

SEQ ID NO: 8177 - protein, 9 aa, Homo Sapiens
EVYGTPGVD

SEQ ID NO: 8178 - protein, 9 aa, Homo Sapiens
YGTPGVDIY

SEQ ID NO: 8179 - protein, 9 aa, Homo Sapiens
PLPLAYAVL

SEQ ID NO: 8180 - protein, 9 aa, Homo Sapiens
YGGILLVNC

SEQ ID NO: 8181 - protein, 9 aa, Homo Sapiens
VQDNCDQHV

SEQ ID NO: 8182 - protein, 9 aa, Homo Sapiens
LQDLEDMSV

SEQ ID NO: 8183 - protein, 9 aa, Homo Sapiens
SYDAKRAQV

SEQ ID NO: 8184 - protein, 9 aa, Homo Sapiens
FHICGPEDV

SEQ ID NO: 8185 - protein, 9 aa, Homo Sapiens
RHVLGQDKV

SEQ ID NO: 8186 - protein, 9 aa, Homo Sapiens
AGFTGLISF

SEQ ID NO: 8187 - protein, 9 aa, Homo Sapiens
FTGLISFHV

SEQ ID NO: 8188 - protein, 9 aa, Homo Sapiens
PWIMTPSTL

SEQ ID NO: 8189 - protein, 9 aa, Homo Sapiens
MTPSTLPPL

SEQ ID NO: 8190 - protein, 9 aa, Homo Sapiens
PSTLPPLEV

SEQ ID NO: 8191 - protein, 9 aa, Homo Sapiens
TREPRDRSV

SEQ ID NO: 8192 - protein, 9 aa, Homo Sapiens
DSFGNLEVS

SEQ ID NO: 8193 - protein, 9 aa, Homo Sapiens
PGSSGRRVT

SEQ ID NO: 8194 - protein, 9 aa, Homo Sapiens
DFLHAQKVQ

SEQ ID NO: 8195 - protein, 9 aa, Homo Sapiens
ELFVDWLAV

SEQ ID NO: 8196 - protein, 9 aa, Homo Sapiens
KGFRMLLAS

SEQ ID NO: 8197 - protein, 9 aa, Homo Sapiens
ASPGACFKL

SEQ ID NO: 8198 - protein, 9 aa, Homo Sapiens
KTISINQVL

SEQ ID NO: 8199 - protein, 9 aa, Homo Sapiens
NQVLSNKDL

SEQ ID NO: 8200 - protein, 9 aa, Homo Sapiens
EVLKRELGL

SEQ ID NO: 8201 - protein, 9 aa, Homo Sapiens
ELGLAECDI

SEQ ID NO: 8202 - protein, 9 aa, Homo Sapiens
LGIPKPFGP

SEQ ID NO: 8203 - protein, 9 aa, Homo Sapiens
GPIINGCCC

SEQ ID NO: 8204 - protein, 9 aa, Homo Sapiens
GCCCLEEKV

SEQ ID NO: 8205 - protein, 9 aa, Homo Sapiens
RSLLEPLGL

SEQ ID NO: 8206 - protein, 9 aa, Homo Sapiens
LGLHCTFID

SEQ ID NO: 8207 - protein, 9 aa, Homo Sapiens
PEGTEMFEV

SEQ ID NO: 8208 - protein, 9 aa, Homo Sapiens
FEVYGTPGV

SEQ ID NO: 8209 - protein, 9 aa, Homo Sapiens
RRWRFDATL

SEQ ID NO: 8210 - protein, 9 aa, Homo Sapiens
ATLEIIVVM

SEQ ID NO: 8211 - protein, 9 aa, Homo Sapiens
SNDLNDSHV

SEQ ID NO: 8212 - protein, 9 aa, Homo Sapiens
PLAYAVLYL

SEQ ID NO: 8213 - protein, 9 aa, Homo Sapiens
GGILLVNCD

SEQ ID NO: 8214 - protein, 9 aa, Homo Sapiens
NCDQHVHCL

SEQ ID NO: 8215 - protein, 9 aa, Homo Sapiens
DMSVMVLRT

SEQ ID NO: 8216 - protein, 9 aa, Homo Sapiens
LRTQGPAAL

SEQ ID NO: 8217 - protein, 9 aa, Homo Sapiens
QGPAALFDD

SEQ ID NO: 8218 - protein, 9 aa, Homo Sapiens
DDHKLVLHT

SEQ ID NO: 8219 - protein, 9 aa, Homo Sapiens
DHKLVLHTS

SEQ ID NO: 8220 - protein, 9 aa, Homo Sapiens
KVSYEVPRL

SEQ ID NO: 8221 - protein, 9 aa, Homo Sapiens
EGLSFPDAG

SEQ ID NO: 8222 - protein, 9 aa, Homo Sapiens
GLISFHVTL

SEQ ID NO: 8223 - protein, 9 aa, Homo Sapiens
CFVDAVAEL

SEQ ID NO: 8224 - protein, 9 aa, Homo Sapiens
QDEMELGYV

SEQ ID NO: 8225 - protein, 9 aa, Homo Sapiens
DEMELGYVQ

SEQ ID NO: 8226 - protein, 9 aa, Homo Sapiens
QDFPYKRIL

SEQ ID NO: 8227 - protein, 9 aa, Homo Sapiens
PRDRSVSGL

SEQ ID NO: 8228 - protein, 9 aa, Homo Sapiens
FGNLEVSPP

SEQ ID NO: 8229 - protein, 9 aa, Homo Sapiens
LGRILIGGN

SEQ ID NO: 8230 - protein, 9 aa, Homo Sapiens
IGGNLPGSS

SEQ ID NO: 8231 - protein, 9 aa, Homo Sapiens
VTQVVRDFL

SEQ ID NO: 8232 - protein, 9 aa, Homo Sapiens
PDGKGFRML

SEQ ID NO: 8233 - protein, 9 aa, Homo Sapiens
CGHGRALLF

SEQ ID NO: 8234 - protein, 9 aa, Homo Sapiens
GRALLFQGV

SEQ ID NO: 8235 - protein, 9 aa, Homo Sapiens
INYNKFVQS

SEQ ID NO: 8236 - protein, 9 aa, Homo Sapiens
CIDWNREVL

SEQ ID NO: 8237 - protein, 9 aa, Homo Sapiens
DWNREVLKR

SEQ ID NO: 8238 - protein, 9 aa, Homo Sapiens
DIPQLFKTE

SEQ ID NO: 8239 - protein, 9 aa, Homo Sapiens
ATAFFPDLV

SEQ ID NO: 8240 - protein, 9 aa, Homo Sapiens
LGKHLGIPK

SEQ ID NO: 8241 - protein, 9 aa, Homo Sapiens
FGPIINGCC

SEQ ID NO: 8242 - protein, 9 aa, Homo Sapiens
GEVHCGTNV

SEQ ID NO: 8243 - protein, 9 aa, Homo Sapiens
SLEHPTSAV

SEQ ID NO: 8244 - protein, 9 aa, Homo Sapiens
PGVDIYISP

SEQ ID NO: 8245 - protein, 9 aa, Homo Sapiens
VMNSPSNDL

SEQ ID NO: 8246 - protein, 9 aa, Homo Sapiens
HSSHEPLPL

SEQ ID NO: 8247 - protein, 9 aa, Homo Sapiens
DRNFVDKRQ

SEQ ID NO: 8248 - protein, 9 aa, Homo Sapiens
EERFFVEGL

SEQ ID NO: 8249 - protein, 9 aa, Homo Sapiens
DFSASPIFT

SEQ ID NO: 8250 - protein, 9 aa, Homo Sapiens
TDTVVFRVA

SEQ ID NO: 8251 - protein, 9 aa, Homo Sapiens
LEVYVCRVR

SEQ ID NO: 8252 - protein, 9 aa, Homo Sapiens
RVRNNTCFV

SEQ ID NO: 8253 - protein, 9 aa, Homo Sapiens
AGCKLTICP

SEQ ID NO: 8254 - protein, 9 aa, Homo Sapiens
FDSPRNGEL

SEQ ID NO: 8255 - protein, 9 aa, Homo Sapiens
QKVQPPVEL

SEQ ID NO: 8256 - protein, 9 aa, Homo Sapiens
PVELFVDWL

SEQ ID NO: 8257 - protein, 9 aa, Homo Sapiens
AVGHVDEFL

SEQ ID NO: 8258 - protein, 9 aa, Homo Sapiens
DEFLSFVPA

SEQ ID NO: 8259 - protein, 9 aa, Homo Sapiens
QKCGHGRAL

SEQ ID NO: 8260 - protein, 9 aa, Homo Sapiens
HGRALLFQG

SEQ ID NO: 8261 - protein, 9 aa, Homo Sapiens
NREVLKREL

SEQ ID NO: 8262 - protein, 9 aa, Homo Sapiens
NGCCCLEEK

SEQ ID NO: 8263 - protein, 9 aa, Homo Sapiens
PYHMLHGEV

SEQ ID NO: 8264 - protein, 9 aa, Homo Sapiens
HGEVHCGTN

SEQ ID NO: 8265 - protein, 9 aa, Homo Sapiens
VSLEHPTSA

SEQ ID NO: 8266 - protein, 9 aa, Homo Sapiens
EMFEVYGTP

SEQ ID NO: 8267 - protein, 9 aa, Homo Sapiens
ISYHSSHEP

SEQ ID NO: 8268 - protein, 9 aa, Homo Sapiens
SYHSSHEPL

SEQ ID NO: 8269 - protein, 9 aa, Homo Sapiens
LYLTCVDIS

SEQ ID NO: 8270 - protein, 9 aa, Homo Sapiens
VDISLDCDL

SEQ ID NO: 8271 - protein, 9 aa, Homo Sapiens
PSGYGGILL

SEQ ID NO: 8272 - protein, 9 aa, Homo Sapiens
DNCDQHVHC

SEQ ID NO: 8273 - protein, 9 aa, Homo Sapiens
QHVHCLQDL

SEQ ID NO: 8274 - protein, 9 aa, Homo Sapiens
QDLEDMSVM

SEQ ID NO: 8275 - protein, 9 aa, Homo Sapiens
MSVMVLRTQ

SEQ ID NO: 8276 - protein, 9 aa, Homo Sapiens
YDAKRAQVF

SEQ ID NO: 8277 - protein, 9 aa, Homo Sapiens
HVLGQDKVS

SEQ ID NO: 8278 - protein, 9 aa, Homo Sapiens
DSNEDFSAS

SEQ ID NO: 8279 - protein, 9 aa, Homo Sapiens
IFTDTVVFR

SEQ ID NO: 8280 - protein, 9 aa, Homo Sapiens
MELGYVQAP

SEQ ID NO: 8281 - protein, 9 aa, Homo Sapiens
NGELQDFPY

SEQ ID NO: 8282 - protein, 9 aa, Homo Sapiens
DFPYKRILG

SEQ ID NO: 8283 - protein, 9 aa, Homo Sapiens
PDFGYVTRE

SEQ ID NO: 8284 - protein, 9 aa, Homo Sapiens
DFGYVTREP

SEQ ID NO: 8285 - protein, 9 aa, Homo Sapiens
LEVSPPVVA

SEQ ID NO: 8286 - protein, 9 aa, Homo Sapiens
LFVDWLAVG

SEQ ID NO: 8287 - protein, 9 aa, Homo Sapiens
VGHVDEFLS

SEQ ID NO: 8288 - protein, 9 aa, Homo Sapiens
PGACFKLFQ

SEQ ID NO: 8289 - protein, 9 aa, Homo Sapiens
LFQGVVDDE

SEQ ID NO: 8290 - protein, 9 aa, Homo Sapiens
DDEQVKTIS

SEQ ID NO: 8291 - protein, 9 aa, Homo Sapiens
WNREVLKRE

SEQ ID NO: 8292 - protein, 9 aa, Homo Sapiens
CDIIDIPQL

SEQ ID NO: 8293 - protein, 9 aa, Homo Sapiens
DLVNMLVLG

SEQ ID NO: 8294 - protein, 9 aa, Homo Sapiens
KVRSLLEPL

SEQ ID NO: 8295 - protein, 9 aa, Homo Sapiens
SLQRIVRVS

SEQ ID NO: 8296 - protein, 9 aa, Homo Sapiens
LEHPTSAVC

SEQ ID NO: 8297 - protein, 9 aa, Homo Sapiens
LVDIYGSVP

SEQ ID NO: 8298 - protein, 9 aa, Homo Sapiens
LEIIVVMNS

SEQ ID NO: 8299 - protein, 9 aa, Homo Sapiens
NDLNDSHVQ

SEQ ID NO: 8300 - protein, 9 aa, Homo Sapiens
ISLDCDLNC

SEQ ID NO: 8301 - protein, 9 aa, Homo Sapiens
DKRQWVWGP

SEQ ID NO: 8302 - protein, 9 aa, Homo Sapiens
GYGGILLVN

SEQ ID NO: 8303 - protein, 9 aa, Homo Sapiens
DDPSCDVQD

SEQ ID NO: 8304 - protein, 9 aa, Homo Sapiens
SSYDAKRAQ

SEQ ID NO: 8305 - protein, 9 aa, Homo Sapiens
DKVSYEVPR

SEQ ID NO: 8306 - protein, 9 aa, Homo Sapiens
GDEERFFVE

SEQ ID NO: 8307 - protein, 9 aa, Homo Sapiens
DEERFFVEG

SEQ ID NO: 8308 - protein, 9 aa, Homo Sapiens
ISFHVTLLD

SEQ ID NO: 8309 - protein, 9 aa, Homo Sapiens
PIFTDTVVF

SEQ ID NO: 8310 - protein, 9 aa, Homo Sapiens
STLPPLEVY

SEQ ID NO: 8311 - protein, 9 aa, Homo Sapiens
EVYVCRVRN

SEQ ID NO: 8312 - protein, 9 aa, Homo Sapiens
NTCFVDAVA

SEQ ID NO: 8313 - protein, 9 aa, Homo Sapiens
AVAELARKA

SEQ ID NO: 8314 - protein, 9 aa, Homo Sapiens
RWIQDEMEL

SEQ ID NO: 8315 - protein, 9 aa, Homo Sapiens
IQDEMELGY

SEQ ID NO: 8316 - protein, 9 aa, Homo Sapiens
PHKTLPVVF

SEQ ID NO: 8317 - protein, 9 aa, Homo Sapiens
KTLPVVFDS

SEQ ID NO: 8318 - protein, 9 aa, Homo Sapiens
VVFDSPRNG

SEQ ID NO: 8319 - protein, 9 aa, Homo Sapiens
DRSVSGLDS

SEQ ID NO: 8320 - protein, 9 aa, Homo Sapiens
VSPPVVANG

SEQ ID NO: 8321 - protein, 9 aa, Homo Sapiens
GRILIGGNL

SEQ ID NO: 8322 - protein, 9 aa, Homo Sapiens
GGNLPGSSG

SEQ ID NO: 8323 - protein, 9 aa, Homo Sapiens
MLLASPGAC

SEQ ID NO: 8324 - protein, 9 aa, Homo Sapiens
LFQEKQKCG

SEQ ID NO: 8325 - protein, 9 aa, Homo Sapiens
KCGHGRALL

SEQ ID NO: 8326 - protein, 9 aa, Homo Sapiens
ALLFQGVVD

SEQ ID NO: 8327 - protein, 9 aa, Homo Sapiens
LLFQGVVDD

SEQ ID NO: 8328 - protein, 9 aa, Homo Sapiens
DIIDIPQLF

SEQ ID NO: 8329 - protein, 9 aa, Homo Sapiens
QLFKTERKK

SEQ ID NO: 8330 - protein, 9 aa, Homo Sapiens
LFKTERKKA

SEQ ID NO: 8331 - protein, 9 aa, Homo Sapiens
VNMLVLGKH

SEQ ID NO: 8332 - protein, 9 aa, Homo Sapiens
PIINGCCCL

SEQ ID NO: 8333 - protein, 9 aa, Homo Sapiens
CCLEEKVRS

SEQ ID NO: 8334 - protein, 9 aa, Homo Sapiens
LHGEVHCGT

SEQ ID NO: 8335 - protein, 9 aa, Homo Sapiens
IVRVSLEHP

SEQ ID NO: 8336 - protein, 9 aa, Homo Sapiens
IYGSVPEGT

SEQ ID NO: 8337 - protein, 9 aa, Homo Sapiens
ISPNMERGR

SEQ ID NO: 8338 - protein, 9 aa, Homo Sapiens
DSHVQISYH

SEQ ID NO: 8339 - protein, 9 aa, Homo Sapiens
AVLYLTCVD

SEQ ID NO: 8340 - protein, 9 aa, Homo Sapiens
DLNCEGRQD

SEQ ID NO: 8341 - protein, 9 aa, Homo Sapiens
GRQDRNFVD

SEQ ID NO: 8342 - protein, 9 aa, Homo Sapiens
FVDKRQWVW

SEQ ID NO: 8343 - protein, 9 aa, Homo Sapiens
GILLVNCDR

SEQ ID NO: 8344 - protein, 9 aa, Homo Sapiens
ILLVNCDRD

SEQ ID NO: 8345 - protein, 9 aa, Homo Sapiens
DVQDNCDQH

SEQ ID NO: 8346 - protein, 9 aa, Homo Sapiens
DQHVHCLQD

SEQ ID NO: 8347 - protein, 9 aa, Homo Sapiens
LVLHTSSYD

SEQ ID NO: 8348 - protein, 9 aa, Homo Sapiens
TLLDDSNED

SEQ ID NO: 8349 - protein, 9 aa, Homo Sapiens
LLDDSNEDF

SEQ ID NO: 8350 - protein, 9 aa, Homo Sapiens
DTVVFRVAP

SEQ ID NO: 8351 - protein, 9 aa, Homo Sapiens
YVCRVRNNT

SEQ ID NO: 8352 - protein, 9 aa, Homo Sapiens
VCRVRNNTC

SEQ ID NO: 8353 - protein, 9 aa, Homo Sapiens
VRNNTCFVD

SEQ ID NO: 8354 - protein, 9 aa, Homo Sapiens
FVDAVAELA

SEQ ID NO: 8355 - protein, 9 aa, Homo Sapiens
ICPQAENRN

SEQ ID NO: 8356 - protein, 9 aa, Homo Sapiens
DRWIQDEME

SEQ ID NO: 8357 - protein, 9 aa, Homo Sapiens
TLPVVFDSP

SEQ ID NO: 8358 - protein, 9 aa, Homo Sapiens
DSPRNGELQ

SEQ ID NO: 8359 - protein, 9 aa, Homo Sapiens
ILIGGNLPG

SEQ ID NO: 8360 - protein, 9 aa, Homo Sapiens
NLPGSSGRR

SEQ ID NO: 8361 - protein, 9 aa, Homo Sapiens
GRRVTQVVR

SEQ ID NO: 8362 - protein, 9 aa, Homo Sapiens
RRVTQVVRD

SEQ ID NO: 8363 - protein, 9 aa, Homo Sapiens
RVTQVVRDF

SEQ ID NO: 8364 - protein, 9 aa, Homo Sapiens
LHAQKVQPP

SEQ ID NO: 8365 - protein, 9 aa, Homo Sapiens
VELFVDWLA

SEQ ID NO: 8366 - protein, 9 aa, Homo Sapiens
FVPAPDGKG

SEQ ID NO: 8367 - protein, 9 aa, Homo Sapiens
VVDDEQVKT

SEQ ID NO: 8368 - protein, 9 aa, Homo Sapiens
ISINQVLSN

SEQ ID NO: 8369 - protein, 9 aa, Homo Sapiens
INQVLSNKD

SEQ ID NO: 8370 - protein, 9 aa, Homo Sapiens
LSNKDLINY

SEQ ID NO: 8371 - protein, 9 aa, Homo Sapiens
KDLINYNKF

SEQ ID NO: 8372 - protein, 9 aa, Homo Sapiens
LINYNKFVQ

SEQ ID NO: 8373 - protein, 9 aa, Homo Sapiens
LKRELGLAE

SEQ ID NO: 8374 - protein, 9 aa, Homo Sapiens
IDIPQLFKT

SEQ ID NO: 8375 - protein, 9 aa, Homo Sapiens
TERKKATAF

SEQ ID NO: 8376 - protein, 9 aa, Homo Sapiens
LVNMLVLGK

SEQ ID NO: 8377 - protein, 9 aa, Homo Sapiens
KHLGIPKPF

SEQ ID NO: 8378 - protein, 9 aa, Homo Sapiens
SLLEPLGLH

SEQ ID NO: 8379 - protein, 9 aa, Homo Sapiens
IDDFTPYHM

SEQ ID NO: 8380 - protein, 9 aa, Homo Sapiens
DFTPYHMLH

SEQ ID NO: 8381 - protein, 9 aa, Homo Sapiens
YHMLHGEVH

SEQ ID NO: 8382 - protein, 9 aa, Homo Sapiens
VHCGTNVCR

SEQ ID NO: 8383 - protein, 9 aa, Homo Sapiens
PTSAVCVAG

SEQ ID NO: 8384 - protein, 9 aa, Homo Sapiens
VETLVDIYG

SEQ ID NO: 8385 - protein, 9 aa, Homo Sapiens
DTRRWRFDA

SEQ ID NO: 8386 - protein, 9 aa, Homo Sapiens
TLEIIVVMN

SEQ ID NO: 8387 - protein, 9 aa, Homo Sapiens
IIVVMNSPS

SEQ ID NO: 8388 - protein, 9 aa, Homo Sapiens
LNDSHVQIS

SEQ ID NO: 8389 - protein, 9 aa, Homo Sapiens
NDSHVQISY

SEQ ID NO: 8390 - protein, 9 aa, Homo Sapiens
DISLDCDLN

SEQ ID NO: 8391 - protein, 9 aa, Homo Sapiens
LDCDLNCEG

SEQ ID NO: 8392 - protein, 9 aa, Homo Sapiens
DCDLNCEGR

SEQ ID NO: 8393 - protein, 9 aa, Homo Sapiens
LNCEGRQDR

SEQ ID NO: 8394 - protein, 9 aa, Homo Sapiens
QDRNFVDKR

SEQ ID NO: 8395 - protein, 9 aa, Homo Sapiens
RDDPSCDVQ

SEQ ID NO: 8396 - protein, 9 aa, Homo Sapiens
MVLRTQGPA

SEQ ID NO: 8397 - protein, 9 aa, Homo Sapiens
FDDHKLVLH

SEQ ID NO: 8398 - protein, 9 aa, Homo Sapiens
TSSYDAKRA

SEQ ID NO: 8399 - protein, 9 aa, Homo Sapiens
HICGPEDVC

SEQ ID NO: 8400 - protein, 9 aa, Homo Sapiens
QDKVSYEVP

SEQ ID NO: 8401 - protein, 9 aa, Homo Sapiens
LHGDEERFF

SEQ ID NO: 8402 - protein, 9 aa, Homo Sapiens
FFVEGLSFP

SEQ ID NO: 8403 - protein, 9 aa, Homo Sapiens
LSFPDAGFT

SEQ ID NO: 8404 - protein, 9 aa, Homo Sapiens
SFPDAGFTG

SEQ ID NO: 8405 - protein, 9 aa, Homo Sapiens
DDSNEDFSA

SEQ ID NO: 8406 - protein, 9 aa, Homo Sapiens
FSASPIFTD

SEQ ID NO: 8407 - protein, 9 aa, Homo Sapiens
IMTPSTLPP

SEQ ID NO: 8408 - protein, 9 aa, Homo Sapiens
VYVCRVRNN

SEQ ID NO: 8409 - protein, 9 aa, Homo Sapiens
TCFVDAVAE

SEQ ID NO: 8410 - protein, 9 aa, Homo Sapiens
ELQDFPYKR

SEQ ID NO: 8411 - protein, 9 aa, Homo Sapiens
YVTREPRDR

SEQ ID NO: 8412 - protein, 9 aa, Homo Sapiens
VTREPRDRS

SEQ ID NO: 8413 - protein, 9 aa, Homo Sapiens
REPRDRSVS

SEQ ID NO: 8414 - protein, 9 aa, Homo Sapiens
LIGGNLPGS

SEQ ID NO: 8415 - protein, 9 aa, Homo Sapiens
GSSGRRVTQ

SEQ ID NO: 8416 - protein, 9 aa, Homo Sapiens
AQKVQPPVE

SEQ ID NO: 8417 - protein, 9 aa, Homo Sapiens
VDEFLSFVP

SEQ ID NO: 8418 - protein, 9 aa, Homo Sapiens
EFLSFVPAP

SEQ ID NO: 8419 - protein, 9 aa, Homo Sapiens
FLSFVPAPD

SEQ ID NO: 8420 - protein, 9 aa, Homo Sapiens
LSFVPAPDG

SEQ ID NO: 8421 - protein, 9 aa, Homo Sapiens
FKLFQEKQK

SEQ ID NO: 8422 - protein, 9 aa, Homo Sapiens
GVVDDEQVK

SEQ ID NO: 8423 - protein, 9 aa, Homo Sapiens
NYNKFVQSC

SEQ ID NO: 8424 - protein, 9 aa, Homo Sapiens
IDWNREVLK

SEQ ID NO: 8425 - protein, 9 aa, Homo Sapiens
RELGLAECD

SEQ ID NO: 8426 - protein, 9 aa, Homo Sapiens
PQLFKTERK

SEQ ID NO: 8427 - protein, 9 aa, Homo Sapiens
FKTERKKAT

SEQ ID NO: 8428 - protein, 9 aa, Homo Sapiens
CCCLEEKVR

SEQ ID NO: 8429 - protein, 9 aa, Homo Sapiens
LLEPLGLHC

SEQ ID NO: 8430 - protein, 9 aa, Homo Sapiens
LEPLGLHCT

SEQ ID NO: 8431 - protein, 9 aa, Homo Sapiens
LHCTFIDDF

SEQ ID NO: 8432 - protein, 9 aa, Homo Sapiens
TFIDDFTPY

SEQ ID NO: 8433 - protein, 9 aa, Homo Sapiens
FTPYHMLHG

SEQ ID NO: 8434 - protein, 9 aa, Homo Sapiens
HMLHGEVHC

SEQ ID NO: 8435 - protein, 9 aa, Homo Sapiens
MLHGEVHCG

SEQ ID NO: 8436 - protein, 9 aa, Homo Sapiens
EVHCGTNVC

SEQ ID NO: 8437 - protein, 9 aa, Homo Sapiens
HCGTNVCRK

SEQ ID NO: 8438 - protein, 9 aa, Homo Sapiens
RKPFSFKWW

SEQ ID NO: 8439 - protein, 9 aa, Homo Sapiens
SFKWWNMVP

SEQ ID NO: 8440 - protein, 9 aa, Homo Sapiens
RIVRVSLEH

SEQ ID NO: 8441 - protein, 9 aa, Homo Sapiens
GVETLVDIY

SEQ ID NO: 8442 - protein, 9 aa, Homo Sapiens
ETLVDIYGS

SEQ ID NO: 8443 - protein, 9 aa, Homo Sapiens
SVPEGTEMF

SEQ ID NO: 8444 - protein, 9 aa, Homo Sapiens
TEMFEVYGT

SEQ ID NO: 8445 - protein, 9 aa, Homo Sapiens
MFEVYGTPG

SEQ ID NO: 8446 - protein, 9 aa, Homo Sapiens
IYISPNMER

SEQ ID NO: 8447 - protein, 9 aa, Homo Sapiens
YISPNMERG

SEQ ID NO: 8448 - protein, 9 aa, Homo Sapiens
PNMERGRER

SEQ ID NO: 8449 - protein, 9 aa, Homo Sapiens
MERGRERAD

SEQ ID NO: 8450 - protein, 9 aa, Homo Sapiens
RERADTRRW

SEQ ID NO: 8451 - protein, 9 aa, Homo Sapiens
ERADTRRWR

SEQ ID NO: 8452 - protein, 9 aa, Homo Sapiens
EIIVVMNSP

SEQ ID NO: 8453 - protein, 9 aa, Homo Sapiens
VVMNSPSND

SEQ ID NO: 8454 - protein, 9 aa, Homo Sapiens
MNSPSNDLN

SEQ ID NO: 8455 - protein, 9 aa, Homo Sapiens
NSPSNDLND

SEQ ID NO: 8456 - protein, 9 aa, Homo Sapiens
SSHEPLPLA

SEQ ID NO: 8457 - protein, 9 aa, Homo Sapiens
AYAVLYLTC

SEQ ID NO: 8458 - protein, 9 aa, Homo Sapiens
LTCVDISLD

SEQ ID NO: 8459 - protein, 9 aa, Homo Sapiens
TCVDISLDC

SEQ ID NO: 8460 - protein, 9 aa, Homo Sapiens
CDLNCEGRQ

SEQ ID NO: 8461 - protein, 9 aa, Homo Sapiens
NCEGRQDRN

SEQ ID NO: 8462 - protein, 9 aa, Homo Sapiens
LLVNCDRDD

SEQ ID NO: 8463 - protein, 9 aa, Homo Sapiens
PSCDVQDNC

SEQ ID NO: 8464 - protein, 9 aa, Homo Sapiens
QDNCDQHVH

SEQ ID NO: 8465 - protein, 9 aa, Homo Sapiens
HCLQDLEDM

SEQ ID NO: 8466 - protein, 9 aa, Homo Sapiens
EDMSVMVLR

SEQ ID NO: 8467 - protein, 9 aa, Homo Sapiens
TQGPAALFD

SEQ ID NO: 8468 - protein, 9 aa, Homo Sapiens
HKLVLHTSS

SEQ ID NO: 8469 - protein, 9 aa, Homo Sapiens
VLHTSSYDA

SEQ ID NO: 8470 - protein, 9 aa, Homo Sapiens
LHTSSYDAK

SEQ ID NO: 8471 - protein, 9 aa, Homo Sapiens
HTSSYDAKR

SEQ ID NO: 8472 - protein, 9 aa, Homo Sapiens
KRAQVFHIC

SEQ ID NO: 8473 - protein, 9 aa, Homo Sapiens
ICGPEDVCE

SEQ ID NO: 8474 - protein, 9 aa, Homo Sapiens
AYRHVLGQD

SEQ ID NO: 8475 - protein, 9 aa, Homo Sapiens
YEVPRLHGD

SEQ ID NO: 8476 - protein, 9 aa, Homo Sapiens
ERFFVEGLS

SEQ ID NO: 8477 - protein, 9 aa, Homo Sapiens
VEGLSFPDA

SEQ ID NO: 8478 - protein, 9 aa, Homo Sapiens
SFHVTLLDD

SEQ ID NO: 8479 - protein, 9 aa, Homo Sapiens
FHVTLLDDS

SEQ ID NO: 8480 - protein, 9 aa, Homo Sapiens
VTLLDDSNE

SEQ ID NO: 8481 - protein, 9 aa, Homo Sapiens
TVVFRVAPW

SEQ ID NO: 8482 - protein, 9 aa, Homo Sapiens
FRVAPWIMT

SEQ ID NO: 8483 - protein, 9 aa, Homo Sapiens
RVAPWIMTP

SEQ ID NO: 8484 - protein, 9 aa, Homo Sapiens
RNNTCFVDA

SEQ ID NO: 8485 - protein, 9 aa, Homo Sapiens
AELARKAGC

SEQ ID NO: 8486 - protein, 9 aa, Homo Sapiens
CKLTICPQA

SEQ ID NO: 8487 - protein, 9 aa, Homo Sapiens
PQAENRNDR

SEQ ID NO: 8488 - protein, 9 aa, Homo Sapiens
NRNDRWIQD

SEQ ID NO: 8489 - protein, 9 aa, Homo Sapiens
GYVQAPHKT

SEQ ID NO: 8490 - protein, 9 aa, Homo Sapiens
HKTLPVVFD

SEQ ID NO: 8491 - protein, 9 aa, Homo Sapiens
GELQDFPYK

SEQ ID NO: 8492 - protein, 9 aa, Homo Sapiens
RILGPDFGY

SEQ ID NO: 8493 - protein, 9 aa, Homo Sapiens
EVSPPVVAN

SEQ ID NO: 8494 - protein, 9 aa, Homo Sapiens
RILIGGNLP

SEQ ID NO: 8495 - protein, 9 aa, Homo Sapiens
QVVRDFLHA

SEQ ID NO: 8496 - protein, 9 aa, Homo Sapiens
VVRDFLHAQ

SEQ ID NO: 8497 - protein, 9 aa, Homo Sapiens
FLHAQKVQP

SEQ ID NO: 8498 - protein, 9 aa, Homo Sapiens
FVDWLAVGH

SEQ ID NO: 8499 - protein, 9 aa, Homo Sapiens
GHVDEFLSF

SEQ ID NO: 8500 - protein, 9 aa, Homo Sapiens
ACFKLFQEK

SEQ ID NO: 8501 - protein, 9 aa, Homo Sapiens
KLFQEKQKC

SEQ ID NO: 8502 - protein, 9 aa, Homo Sapiens
FQGVVDDEQ

SEQ ID NO: 8503 - protein, 9 aa, Homo Sapiens
EQVKTISIN

SEQ ID NO: 8504 - protein, 9 aa, Homo Sapiens
SINQVLSNK

SEQ ID NO: 8505 - protein, 9 aa, Homo Sapiens
VLSNKDLIN

SEQ ID NO: 8506 - protein, 9 aa, Homo Sapiens
SNKDLINYN

SEQ ID NO: 8507 - protein, 9 aa, Homo Sapiens
GLAECDIID

SEQ ID NO: 8508 - protein, 9 aa, Homo Sapiens
IIDIPQLFK

SEQ ID NO: 8509 - protein, 9 aa, Homo Sapiens
KTERKKATA

SEQ ID NO: 8510 - protein, 9 aa, Homo Sapiens
RKKATAFFP

SEQ ID NO: 8511 - protein, 9 aa, Homo Sapiens
AFFPDLVNM

SEQ ID NO: 8512 - protein, 9 aa, Homo Sapiens
VLGKHLGIP

SEQ ID NO: 8513 - protein, 9 aa, Homo Sapiens
GKHLGIPKP

SEQ ID NO: 8514 - protein, 9 aa, Homo Sapiens
PKPFGPIIN

SEQ ID NO: 8515 - protein, 9 aa, Homo Sapiens
IINGCCCLE

SEQ ID NO: 8516 - protein, 9 aa, Homo Sapiens
INGCCCLEE

SEQ ID NO: 8517 - protein, 9 aa, Homo Sapiens
EKVRSLLEP

SEQ ID NO: 8518 - protein, 9 aa, Homo Sapiens
GLHCTFIDD

SEQ ID NO: 8519 - protein, 9 aa, Homo Sapiens
CTFIDDFTP

SEQ ID NO: 8520 - protein, 9 aa, Homo Sapiens
NVCRKPFSF

SEQ ID NO: 8521 - protein, 9 aa, Homo Sapiens
VCRKPFSFK

SEQ ID NO: 8522 - protein, 9 aa, Homo Sapiens
QRIVRVSLE

SEQ ID NO: 8523 - protein, 9 aa, Homo Sapiens
RVSLEHPTS

SEQ ID NO: 8524 - protein, 9 aa, Homo Sapiens
VDIYGSVPE

SEQ ID NO: 8525 - protein, 9 aa, Homo Sapiens
GVDIYISPN

SEQ ID NO: 8526 - protein, 9 aa, Homo Sapiens
NMERGRERA

SEQ ID NO: 8527 - protein, 9 aa, Homo Sapiens
GRERADTRR

SEQ ID NO: 8528 - protein, 9 aa, Homo Sapiens
TRRWRFDAT

SEQ ID NO: 8529 - protein, 9 aa, Homo Sapiens
RWRFDATLE

SEQ ID NO: 8530 - protein, 9 aa, Homo Sapiens
IVVMNSPSN

SEQ ID NO: 8531 - protein, 9 aa, Homo Sapiens
PSNDLNDSH

SEQ ID NO: 8532 - protein, 9 aa, Homo Sapiens
VQISYHSSH

SEQ ID NO: 8533 - protein, 9 aa, Homo Sapiens
YHSSHEPLP

SEQ ID NO: 8534 - protein, 9 aa, Homo Sapiens
SHEPLPLAY

SEQ ID NO: 8535 - protein, 9 aa, Homo Sapiens
HEPLPLAYA

SEQ ID NO: 8536 - protein, 9 aa, Homo Sapiens
CVDISLDCD

SEQ ID NO: 8537 - protein, 9 aa, Homo Sapiens
SLDCDLNCE

SEQ ID NO: 8538 - protein, 9 aa, Homo Sapiens
RQDRNFVDK

SEQ ID NO: 8539 - protein, 9 aa, Homo Sapiens
RNFVDKRQW

SEQ ID NO: 8540 - protein, 9 aa, Homo Sapiens
VDKRQWVWG

SEQ ID NO: 8541 - protein, 9 aa, Homo Sapiens
KRQWVWGPS

SEQ ID NO: 8542 - protein, 9 aa, Homo Sapiens
WVWGPSGYG

SEQ ID NO: 8543 - protein, 9 aa, Homo Sapiens
VWGPSGYGG

SEQ ID NO: 8544 - protein, 9 aa, Homo Sapiens
LVNCDRDDP

SEQ ID NO: 8545 - protein, 9 aa, Homo Sapiens
VNCDRDDPS

SEQ ID NO: 8546 - protein, 9 aa, Homo Sapiens
CDRDDPSCD

SEQ ID NO: 8547 - protein, 9 aa, Homo Sapiens
CDQHVHCLQ

SEQ ID NO: 8548 - protein, 9 aa, Homo Sapiens
VHCLQDLED

SEQ ID NO: 8549 - protein, 9 aa, Homo Sapiens
VLRTQGPAA

SEQ ID NO: 8550 - protein, 9 aa, Homo Sapiens
RTQGPAALF

SEQ ID NO: 8551 - protein, 9 aa, Homo Sapiens
EDVCEAYRH

SEQ ID NO: 8552 - protein, 9 aa, Homo Sapiens
YRHVLGQDK

SEQ ID NO: 8553 - protein, 9 aa, Homo Sapiens
VLGQDKVSY

SEQ ID NO: 8554 - protein, 9 aa, Homo Sapiens
SYEVPRLHG

SEQ ID NO: 8555 - protein, 9 aa, Homo Sapiens
PRLHGDEER

SEQ ID NO: 8556 - protein, 9 aa, Homo Sapiens
RLHGDEERF

SEQ ID NO: 8557 - protein, 9 aa, Homo Sapiens
RFFVEGLSF

SEQ ID NO: 8558 - protein, 9 aa, Homo Sapiens
FVEGLSFPD

SEQ ID NO: 8559 - protein, 9 aa, Homo Sapiens
GFTGLISFH

SEQ ID NO: 8560 - protein, 9 aa, Homo Sapiens
LDDSNEDFS

SEQ ID NO: 8561 - protein, 9 aa, Homo Sapiens
VFRVAPWIM

SEQ ID NO: 8562 - protein, 9 aa, Homo Sapiens
WIMTPSTLP

SEQ ID NO: 8563 - protein, 9 aa, Homo Sapiens
CRVRNNTCF

SEQ ID NO: 8564 - protein, 9 aa, Homo Sapiens
VDAVAELAR

SEQ ID NO: 8565 - protein, 9 aa, Homo Sapiens
ELARKAGCK

SEQ ID NO: 8566 - protein, 9 aa, Homo Sapiens
ARKAGCKLT

SEQ ID NO: 8567 - protein, 9 aa, Homo Sapiens
GCKLTICPQ

SEQ ID NO: 8568 - protein, 9 aa, Homo Sapiens
LTICPQAEN

SEQ ID NO: 8569 - protein, 9 aa, Homo Sapiens
TICPQAENR

SEQ ID NO: 8570 - protein, 9 aa, Homo Sapiens
ELGYVQAPH

SEQ ID NO: 8571 - protein, 9 aa, Homo Sapiens
VQAPHKTLP

SEQ ID NO: 8572 - protein, 9 aa, Homo Sapiens
VFDSPRNGE

SEQ ID NO: 8573 - protein, 9 aa, Homo Sapiens
PRNGELQDF

SEQ ID NO: 8574 - protein, 9 aa, Homo Sapiens
RNGELQDFP

SEQ ID NO: 8575 - protein, 9 aa, Homo Sapiens
YKRILGPDF

SEQ ID NO: 8576 - protein, 9 aa, Homo Sapiens
GYVTREPRD

SEQ ID NO: 8577 - protein, 9 aa, Homo Sapiens
RDRSVSGLD

SEQ ID NO: 8578 - protein, 9 aa, Homo Sapiens
PVVANGKEY

SEQ ID NO: 8579 - protein, 9 aa, Homo Sapiens
PLGRILIGG

SEQ ID NO: 8580 - protein, 9 aa, Homo Sapiens
GNLPGSSGR

SEQ ID NO: 8581 - protein, 9 aa, Homo Sapiens
KVQPPVELF

SEQ ID NO: 8582 - protein, 9 aa, Homo Sapiens
FRMLLASPG

SEQ ID NO: 8583 - protein, 9 aa, Homo Sapiens
RMLLASPGA

SEQ ID NO: 8584 - protein, 9 aa, Homo Sapiens
LLASPGACF

SEQ ID NO: 8585 - protein, 9 aa, Homo Sapiens
CFKLFQEKQ

SEQ ID NO: 8586 - protein, 9 aa, Homo Sapiens
FQEKQKCGH

SEQ ID NO: 8587 - protein, 9 aa, Homo Sapiens
QEKQKCGHG

SEQ ID NO: 8588 - protein, 9 aa, Homo Sapiens
GHGRALLFQ

SEQ ID NO: 8589 - protein, 9 aa, Homo Sapiens
QVKTISINQ

SEQ ID NO: 8590 - protein, 9 aa, Homo Sapiens
TISINQVLS

SEQ ID NO: 8591 - protein, 9 aa, Homo Sapiens
NKDLINYNK

SEQ ID NO: 8592 - protein, 9 aa, Homo Sapiens
NKFVQSCID

SEQ ID NO: 8593 - protein, 9 aa, Homo Sapiens
KFVQSCIDW

SEQ ID NO: 8594 - protein, 9 aa, Homo Sapiens
FVQSCIDWN

SEQ ID NO: 8595 - protein, 9 aa, Homo Sapiens
QSCIDWNRE

SEQ ID NO: 8596 - protein, 9 aa, Homo Sapiens
VLKRELGLA

SEQ ID NO: 8597 - protein, 9 aa, Homo Sapiens
AECDIIDIP

SEQ ID NO: 8598 - protein, 9 aa, Homo Sapiens
KKATAFFPD

SEQ ID NO: 8599 - protein, 9 aa, Homo Sapiens
PFGPIINGC

SEQ ID NO: 8600 - protein, 9 aa, Homo Sapiens
FIDDFTPYH

SEQ ID NO: 8601 - protein, 9 aa, Homo Sapiens
CRKPFSFKW

SEQ ID NO: 8602 - protein, 9 aa, Homo Sapiens
VRVSLEHPT

SEQ ID NO: 8603 - protein, 9 aa, Homo Sapiens
AVCVAGVET

SEQ ID NO: 8604 - protein, 9 aa, Homo Sapiens
GSVPEGTEM

SEQ ID NO: 8605 - protein, 9 aa, Homo Sapiens
GTEMFEVYG

SEQ ID NO: 8606 - protein, 9 aa, Homo Sapiens
VDIYISPNM

SEQ ID NO: 8607 - protein, 9 aa, Homo Sapiens
ADTRRWRFD

SEQ ID NO: 8608 - protein, 9 aa, Homo Sapiens
SHVQISYHS

SEQ ID NO: 8609 - protein, 9 aa, Homo Sapiens
HVQISYHSS

SEQ ID NO: 8610 - protein, 9 aa, Homo Sapiens
QISYHSSHE

SEQ ID NO: 8611 - protein, 9 aa, Homo Sapiens
CEGRQDRNF

SEQ ID NO: 8612 - protein, 9 aa, Homo Sapiens
RQWVWGPSG

SEQ ID NO: 8613 - protein, 9 aa, Homo Sapiens
QWVWGPSGY

SEQ ID NO: 8614 - protein, 9 aa, Homo Sapiens
NCDRDDPSC

SEQ ID NO: 8615 - protein, 9 aa, Homo Sapiens
SCDVQDNCD

SEQ ID NO: 8616 - protein, 9 aa, Homo Sapiens
CDVQDNCDQ

SEQ ID NO: 8617 - protein, 9 aa, Homo Sapiens
CLQDLEDMS

SEQ ID NO: 8618 - protein, 9 aa, Homo Sapiens
SVMVLRTQG

SEQ ID NO: 8619 - protein, 9 aa, Homo Sapiens
VMVLRTQGP

SEQ ID NO: 8620 - protein, 9 aa, Homo Sapiens
AQVFHICGP

SEQ ID NO: 8621 - protein, 9 aa, Homo Sapiens
QVFHICGPE

SEQ ID NO: 8622 - protein, 9 aa, Homo Sapiens
VFHICGPED

SEQ ID NO: 8623 - protein, 9 aa, Homo Sapiens
CEAYRHVLG

SEQ ID NO: 8624 - protein, 9 aa, Homo Sapiens
EVPRLHGDE

SEQ ID NO: 8625 - protein, 9 aa, Homo Sapiens
SNEDFSASP

SEQ ID NO: 8626 - protein, 9 aa, Homo Sapiens
EDFSASPIF

SEQ ID NO: 8627 - protein, 9 aa, Homo Sapiens
KLTICPQAE

SEQ ID NO: 8628 - protein, 9 aa, Homo Sapiens
RNDRWIQDE

SEQ ID NO: 8629 - protein, 9 aa, Homo Sapiens
NDRWIQDEM

SEQ ID NO: 8630 - protein, 9 aa, Homo Sapiens
WIQDEMELG

SEQ ID NO: 8631 - protein, 9 aa, Homo Sapiens
EMELGYVQA

SEQ ID NO: 8632 - protein, 9 aa, Homo Sapiens
PVVFDSPRN

SEQ ID NO: 8633 - protein, 9 aa, Homo Sapiens
PYKRILGPD

SEQ ID NO: 8634 - protein, 9 aa, Homo Sapiens
KRILGPDFG

SEQ ID NO: 8635 - protein, 9 aa, Homo Sapiens
RSVSGLDSF

SEQ ID NO: 8636 - protein, 9 aa, Homo Sapiens
SVSGLDSFG

SEQ ID NO: 8637 - protein, 9 aa, Homo Sapiens
VSGLDSFGN

SEQ ID NO: 8638 - protein, 9 aa, Homo Sapiens
GLDSFGNLE

SEQ ID NO: 8639 - protein, 9 aa, Homo Sapiens
SFGNLEVSP

SEQ ID NO: 8640 - protein, 9 aa, Homo Sapiens
VVANGKEYP

SEQ ID NO: 8641 - protein, 9 aa, Homo Sapiens
ANGKEYPLG

SEQ ID NO: 8642 - protein, 9 aa, Homo Sapiens
TQVVRDFLH

SEQ ID NO: 8643 - protein, 9 aa, Homo Sapiens
VRDFLHAQK

SEQ ID NO: 8644 - protein, 9 aa, Homo Sapiens
WLAVGHVDE

SEQ ID NO: 8645 - protein, 9 aa, Homo Sapiens
SFVPAPDGK

SEQ ID NO: 8646 - protein, 9 aa, Homo Sapiens
GKGFRMLLA

SEQ ID NO: 8647 - protein, 9 aa, Homo Sapiens
GFRMLLASP

SEQ ID NO: 8648 - protein, 9 aa, Homo Sapiens
EKQKCGHGR

SEQ ID NO: 8649 - protein, 10 aa, Homo Sapiens
LNDSHVQISY

SEQ ID NO: 8650 - protein, 10 aa, Homo Sapiens
SSHEPLPLAY

SEQ ID NO: 8651 - protein, 10 aa, Homo Sapiens
CTFIDDFTPY

SEQ ID NO: 8652 - protein, 10 aa, Homo Sapiens
FTDTVVFRVA

SEQ ID NO: 8653 - protein, 10 aa, Homo Sapiens
WIQDEMELGY

SEQ ID NO: 8654 - protein, 10 aa, Homo Sapiens
VLSNKDLINY

SEQ ID NO: 8655 - protein, 10 aa, Homo Sapiens
PSTLPPLEVY

SEQ ID NO: 8656 - protein, 10 aa, Homo Sapiens
PEGTEMFEVY

SEQ ID NO: 8657 - protein, 10 aa, Homo Sapiens
PLPLAYAVLY

SEQ ID NO: 8658 - protein, 10 aa, Homo Sapiens
FDDHKLVLHT

SEQ ID NO: 8659 - protein, 10 aa, Homo Sapiens
GLDSFGNLEV

SEQ ID NO: 8660 - protein, 10 aa, Homo Sapiens
FPDLVNMLVL

SEQ ID NO: 8661 - protein, 10 aa, Homo Sapiens
LEEKVRSLLE

SEQ ID NO: 8662 - protein, 10 aa, Homo Sapiens
AGVETLVDIY

SEQ ID NO: 8663 - protein, 10 aa, Homo Sapiens
GTEMFEVYGT

SEQ ID NO: 8664 - protein, 10 aa, Homo Sapiens
VYGTPGVDIY

SEQ ID NO: 8665 - protein, 10 aa, Homo Sapiens
FVDAVAELAR

SEQ ID NO: 8666 - protein, 10 aa, Homo Sapiens
SHEPLPLAYA

SEQ ID NO: 8667 - protein, 10 aa, Homo Sapiens
HVLGQDKVSY

SEQ ID NO: 8668 - protein, 10 aa, Homo Sapiens
TREPRDRSVS

SEQ ID NO: 8669 - protein, 10 aa, Homo Sapiens
PPVVANGKEY

SEQ ID NO: 8670 - protein, 10 aa, Homo Sapiens
APDGKGFRML

SEQ ID NO: 8671 - protein, 10 aa, Homo Sapiens
KTERKKATAF

SEQ ID NO: 8672 - protein, 10 aa, Homo Sapiens
RQWVWGPSGY

SEQ ID NO: 8673 - protein, 10 aa, Homo Sapiens
HKLVLHTSSY

SEQ ID NO: 8674 - protein, 10 aa, Homo Sapiens
CGPEDVCEAY

SEQ ID NO: 8675 - protein, 10 aa, Homo Sapiens
FVEGLSFPDA

SEQ ID NO: 8676 - protein, 10 aa, Homo Sapiens
RNGELQDFPY

SEQ ID NO: 8677 - protein, 10 aa, Homo Sapiens
KRILGPDFGY

SEQ ID NO: 8678 - protein, 10 aa, Homo Sapiens
LLEPLGLHCT

SEQ ID NO: 8679 - protein, 10 aa, Homo Sapiens
SLEHPTSAVC

SEQ ID NO: 8680 - protein, 10 aa, Homo Sapiens
GVETLVDIYG

SEQ ID NO: 8681 - protein, 10 aa, Homo Sapiens
RFDATLEIIV

SEQ ID NO: 8682 - protein, 10 aa, Homo Sapiens
SLDCDLNCEG

SEQ ID NO: 8683 - protein, 10 aa, Homo Sapiens
RDDPSCDVQD

SEQ ID NO: 8684 - protein, 10 aa, Homo Sapiens
HGDEERFFVE

SEQ ID NO: 8685 - protein, 10 aa, Homo Sapiens
VDEFLSFVPA

SEQ ID NO: 8686 - protein, 10 aa, Homo Sapiens
DDEQVKTISI

SEQ ID NO: 8687 - protein, 10 aa, Homo Sapiens
ATAFFPDLVN

SEQ ID NO: 8688 - protein, 10 aa, Homo Sapiens
CLEEKVRSLL

SEQ ID NO: 8689 - protein, 10 aa, Homo Sapiens
SNDLNDSHVQ

SEQ ID NO: 8690 - protein, 10 aa, Homo Sapiens
RQDRNFVDKR

SEQ ID NO: 8691 - protein, 10 aa, Homo Sapiens
SCDVQDNCDQ

SEQ ID NO: 8692 - protein, 10 aa, Homo Sapiens
DLEDMSVMVL

SEQ ID NO: 8693 - protein, 10 aa, Homo Sapiens
RTQGPAALFD

SEQ ID NO: 8694 - protein, 10 aa, Homo Sapiens
SYDAKRAQVF

SEQ ID NO: 8695 - protein, 10 aa, Homo Sapiens
VCEAYRHVLG

SEQ ID NO: 8696 - protein, 10 aa, Homo Sapiens
GDEERFFVEG

SEQ ID NO: 8697 - protein, 10 aa, Homo Sapiens
FPDAGFTGLI

SEQ ID NO: 8698 - protein, 10 aa, Homo Sapiens
KTLPVVFDSP

SEQ ID NO: 8699 - protein, 10 aa, Homo Sapiens
NGELQDFPYK

SEQ ID NO: 8700 - protein, 10 aa, Homo Sapiens
VRDFLHAQKV

SEQ ID NO: 8701 - protein, 10 aa, Homo Sapiens
NREVLKRELG

SEQ ID NO: 8702 - protein, 10 aa, Homo Sapiens
VPEGTEMFEV

SEQ ID NO: 8703 - protein, 10 aa, Homo Sapiens
TLEIIVVMNS

SEQ ID NO: 8704 - protein, 10 aa, Homo Sapiens
LTCVDISLDC

SEQ ID NO: 8705 - protein, 10 aa, Homo Sapiens
PSGYGGILLV

SEQ ID NO: 8706 - protein, 10 aa, Homo Sapiens
VQDNCDQHVH

SEQ ID NO: 8707 - protein, 10 aa, Homo Sapiens
NCDQHVHCLQ

SEQ ID NO: 8708 - protein, 10 aa, Homo Sapiens
LEDMSVMVLR

SEQ ID NO: 8709 - protein, 10 aa, Homo Sapiens
LFDDHKLVLH

SEQ ID NO: 8710 - protein, 10 aa, Homo Sapiens
VSYEVPRLHG

SEQ ID NO: 8711 - protein, 10 aa, Homo Sapiens
SYEVPRLHGD

SEQ ID NO: 8712 - protein, 10 aa, Homo Sapiens
SNEDFSASPI

SEQ ID NO: 8713 - protein, 10 aa, Homo Sapiens
STLPPLEVYV

SEQ ID NO: 8714 - protein, 10 aa, Homo Sapiens
PLEVYVCRVR

SEQ ID NO: 8715 - protein, 10 aa, Homo Sapiens
QDEMELGYVQ

SEQ ID NO: 8716 - protein, 10 aa, Homo Sapiens
VFDSPRNGEL

SEQ ID NO: 8717 - protein, 10 aa, Homo Sapiens
PRDRSVSGLD

SEQ ID NO: 8718 - protein, 10 aa, Homo Sapiens
NLEVSPPVVA

SEQ ID NO: 8719 - protein, 10 aa, Homo Sapiens
PVELFVDWLA

SEQ ID NO: 8720 - protein, 10 aa, Homo Sapiens
FVDWLAVGHV

SEQ ID NO: 8721 - protein, 10 aa, Homo Sapiens
VVDDEQVKTI

SEQ ID NO: 8722 - protein, 10 aa, Homo Sapiens
NKDLINYNKF

SEQ ID NO: 8723 - protein, 10 aa, Homo Sapiens
CIDWNREVLK

SEQ ID NO: 8724 - protein, 10 aa, Homo Sapiens
IIDIPQLFKT

SEQ ID NO: 8725 - protein, 10 aa, Homo Sapiens
NCEGRQDRNF

SEQ ID NO: 8726 - protein, 10 aa, Homo Sapiens
FVDKRQWVWG

SEQ ID NO: 8727 - protein, 10 aa, Homo Sapiens
DRDDPSCDVQ

SEQ ID NO: 8728 - protein, 10 aa, Homo Sapiens
LQDLEDMSVM

SEQ ID NO: 8729 - protein, 10 aa, Homo Sapiens
GQDKVSYEVP

SEQ ID NO: 8730 - protein, 10 aa, Homo Sapiens
DEERFFVEGL

SEQ ID NO: 8731 - protein, 10 aa, Homo Sapiens
FTGLISFHVT

SEQ ID NO: 8732 - protein, 10 aa, Homo Sapiens
LLDDSNEDFS

SEQ ID NO: 8733 - protein, 10 aa, Homo Sapiens
VAELARKAGC

SEQ ID NO: 8734 - protein, 10 aa, Homo Sapiens
EMELGYVQAP

SEQ ID NO: 8735 - protein, 10 aa, Homo Sapiens
VQAPHKTLPV

SEQ ID NO: 8736 - protein, 10 aa, Homo Sapiens
QDFPYKRILG

SEQ ID NO: 8737 - protein, 10 aa, Homo Sapiens
GPDFGYVTRE

SEQ ID NO: 8738 - protein, 10 aa, Homo Sapiens
GKEYPLGRIL

SEQ ID NO: 8739 - protein, 10 aa, Homo Sapiens
KEYPLGRILI

SEQ ID NO: 8740 - protein, 10 aa, Homo Sapiens
HVDEFLSFVP

SEQ ID NO: 8741 - protein, 10 aa, Homo Sapiens
ASPGACFKLF

SEQ ID NO: 8742 - protein, 10 aa, Homo Sapiens
FQEKQKCGHG

SEQ ID NO: 8743 - protein, 10 aa, Homo Sapiens
VDDEQVKTIS

SEQ ID NO: 8744 - protein, 10 aa, Homo Sapiens
FIDDFTPYHM

SEQ ID NO: 8745 - protein, 10 aa, Homo Sapiens
IDDFTPYHML

SEQ ID NO: 8746 - protein, 10 aa, Homo Sapiens
HGEVHCGTNV

SEQ ID NO: 8747 - protein, 10 aa, Homo Sapiens
LVDIYGSVPE

SEQ ID NO: 8748 - protein, 10 aa, Homo Sapiens
MFEVYGTPGV

SEQ ID NO: 8749 - protein, 10 aa, Homo Sapiens
YGTPGVDIYI

SEQ ID NO: 8750 - protein, 10 aa, Homo Sapiens
GVDIYISPNM

SEQ ID NO: 8751 - protein, 10 aa, Homo Sapiens
NMERGRERAD

SEQ ID NO: 8752 - protein, 10 aa, Homo Sapiens
GRERADTRRW

SEQ ID NO: 8753 - protein, 10 aa, Homo Sapiens
RADTRRWRFD

SEQ ID NO: 8754 - protein, 10 aa, Homo Sapiens
MNSPSNDLND

SEQ ID NO: 8755 - protein, 10 aa, Homo Sapiens
CVDISLDCDL

SEQ ID NO: 8756 - protein, 10 aa, Homo Sapiens
DCDLNCEGRQ

SEQ ID NO: 8757 - protein, 10 aa, Homo Sapiens
SGYGGILLVN

SEQ ID NO: 8758 - protein, 10 aa, Homo Sapiens
NCDRDDPSCD

SEQ ID NO: 8759 - protein, 10 aa, Homo Sapiens
GPEDVCEAYR

SEQ ID NO: 8760 - protein, 10 aa, Homo Sapiens
PEDVCEAYRH

SEQ ID NO: 8761 - protein, 10 aa, Homo Sapiens
ISFHVTLLDD

SEQ ID NO: 8762 - protein, 10 aa, Homo Sapiens
LDDSNEDFSA

SEQ ID NO: 8763 - protein, 10 aa, Homo Sapiens
NEDFSASPIF

SEQ ID NO: 8764 - protein, 10 aa, Homo Sapiens
QAENRNDRWI

SEQ ID NO: 8765 - protein, 10 aa, Homo Sapiens
RNDRWIQDEM

SEQ ID NO: 8766 - protein, 10 aa, Homo Sapiens
IQDEMELGYV

SEQ ID NO: 8767 - protein, 10 aa, Homo Sapiens
DSPRNGELQD

SEQ ID NO: 8768 - protein, 10 aa, Homo Sapiens
LQDFPYKRIL

SEQ ID NO: 8769 - protein, 10 aa, Homo Sapiens
KVQPPVELFV

SEQ ID NO: 8770 - protein, 10 aa, Homo Sapiens
VGHVDEFLSF

SEQ ID NO: 8771 - protein, 10 aa, Homo Sapiens
KRELGLAECD

SEQ ID NO: 8772 - protein, 10 aa, Homo Sapiens
LAECDIIDIP

SEQ ID NO: 8773 - protein, 10 aa, Homo Sapiens
ECDIIDIPQL

SEQ ID NO: 8774 - protein, 10 aa, Homo Sapiens
SLLEPLGLHC

SEQ ID NO: 8775 - protein, 10 aa, Homo Sapiens
DFTPYHMLHG

SEQ ID NO: 8776 - protein, 10 aa, Homo Sapiens
GSVPEGTEMF

SEQ ID NO: 8777 - protein, 10 aa, Homo Sapiens
DTRRWRFDAT

SEQ ID NO: 8778 - protein, 10 aa, Homo Sapiens
ATLEIIVVMN

SEQ ID NO: 8779 - protein, 10 aa, Homo Sapiens
ALFDDHKLVL

SEQ ID NO: 8780 - protein, 10 aa, Homo Sapiens
LSFPDAGFTG

SEQ ID NO: 8781 - protein, 10 aa, Homo Sapiens
VSPPVVANGK

SEQ ID NO: 8782 - protein, 10 aa, Homo Sapiens
VTQVVRDFLH

SEQ ID NO: 8783 - protein, 10 aa, Homo Sapiens
TQVVRDFLHA

SEQ ID NO: 8784 - protein, 10 aa, Homo Sapiens
DGKGFRMLLA

SEQ ID NO: 8785 - protein, 10 aa, Homo Sapiens
IDWNREVLKR

SEQ ID NO: 8786 - protein, 10 aa, Homo Sapiens
VLKRELGLAE

SEQ ID NO: 8787 - protein, 10 aa, Homo Sapiens
CVAGVETLVD

SEQ ID NO: 8788 - protein, 10 aa, Homo Sapiens
YHSSHEPLPL

SEQ ID NO: 8789 - protein, 10 aa, Homo Sapiens
GPSGYGGILL

SEQ ID NO: 8790 - protein, 10 aa, Homo Sapiens
PDAGFTGLIS

SEQ ID NO: 8791 - protein, 10 aa, Homo Sapiens
LISFHVTLLD

SEQ ID NO: 8792 - protein, 10 aa, Homo Sapiens
FSASPIFTDT

SEQ ID NO: 8793 - protein, 10 aa, Homo Sapiens
MTPSTLPPLE

SEQ ID NO: 8794 - protein, 10 aa, Homo Sapiens
FDSPRNGELQ

SEQ ID NO: 8795 - protein, 10 aa, Homo Sapiens
VSGLDSFGNL

SEQ ID NO: 8796 - protein, 10 aa, Homo Sapiens
SFVPAPDGKG

SEQ ID NO: 8797 - protein, 10 aa, Homo Sapiens
SPGACFKLFQ

SEQ ID NO: 8798 - protein, 10 aa, Homo Sapiens
KCGHGRALLF

SEQ ID NO: 8799 - protein, 10 aa, Homo Sapiens
KTISINQVLS

SEQ ID NO: 8800 - protein, 10 aa, Homo Sapiens
DLVNMLVLGK

SEQ ID NO: 8801 - protein, 10 aa, Homo Sapiens
IPKPFGPIIN

SEQ ID NO: 8802 - protein, 10 aa, Homo Sapiens
PTSAVCVAGV

SEQ ID NO: 8803 - protein, 10 aa, Homo Sapiens
GTPGVDIYIS

SEQ ID NO: 8804 - protein, 10 aa, Homo Sapiens
LPLAYAVLYL

SEQ ID NO: 8805 - protein, 10 aa, Homo Sapiens
EDMSVMVLRT

SEQ ID NO: 8806 - protein, 10 aa, Homo Sapiens
SSYDAKRAQV

SEQ ID NO: 8807 - protein, 10 aa, Homo Sapiens
CEAYRHVLGQ

SEQ ID NO: 8808 - protein, 10 aa, Homo Sapiens
ERFFVEGLSF

SEQ ID NO: 8809 - protein, 10 aa, Homo Sapiens
VTLLDDSNED

SEQ ID NO: 8810 - protein, 10 aa, Homo Sapiens
DTVVFRVAPW

SEQ ID NO: 8811 - protein, 10 aa, Homo Sapiens
TLPPLEVYVC

SEQ ID NO: 8812 - protein, 10 aa, Homo Sapiens
ARKAGCKLTI

SEQ ID NO: 8813 - protein, 10 aa, Homo Sapiens
ILGPDFGYVT

SEQ ID NO: 8814 - protein, 10 aa, Homo Sapiens
VTREPRDRSV

SEQ ID NO: 8815 - protein, 10 aa, Homo Sapiens
RDRSVSGLDS

SEQ ID NO: 8816 - protein, 10 aa, Homo Sapiens
ANGKEYPLGR

SEQ ID NO: 8817 - protein, 10 aa, Homo Sapiens
YPLGRILIGG

SEQ ID NO: 8818 - protein, 10 aa, Homo Sapiens
RILIGGNLPG

SEQ ID NO: 8819 - protein, 10 aa, Homo Sapiens
SSGRRVTQVV

SEQ ID NO: 8820 - protein, 10 aa, Homo Sapiens
VELFVDWLAV

SEQ ID NO: 8821 - protein, 10 aa, Homo Sapiens
CGHGRALLFQ

SEQ ID NO: 8822 - protein, 10 aa, Homo Sapiens
TISINQVLSN

SEQ ID NO: 8823 - protein, 10 aa, Homo Sapiens
IDIPQLFKTE

SEQ ID NO: 8824 - protein, 10 aa, Homo Sapiens
AFFPDLVNML

SEQ ID NO: 8825 - protein, 10 aa, Homo Sapiens
MLVLGKHLGI

SEQ ID NO: 8826 - protein, 10 aa, Homo Sapiens
VLGKHLGIPK

SEQ ID NO: 8827 - protein, 10 aa, Homo Sapiens
LGIPKPFGPI

SEQ ID NO: 8828 - protein, 10 aa, Homo Sapiens
IINGCCCLEE

SEQ ID NO: 8829 - protein, 10 aa, Homo Sapiens
VRSLLEPLGL

SEQ ID NO: 8830 - protein, 10 aa, Homo Sapiens
LGLHCTFIDD

SEQ ID NO: 8831 - protein, 10 aa, Homo Sapiens
FTPYHMLHGE

SEQ ID NO: 8832 - protein, 10 aa, Homo Sapiens
CRKPFSFKWW

SEQ ID NO: 8833 - protein, 10 aa, Homo Sapiens
FSFKWWNMVP

SEQ ID NO: 8834 - protein, 10 aa, Homo Sapiens
MSLQRIVRVS

SEQ ID NO: 8835 - protein, 10 aa, Homo Sapiens
QRIVRVSLEH

SEQ ID NO: 8836 - protein, 10 aa, Homo Sapiens
ETLVDIYGSV

SEQ ID NO: 8837 - protein, 10 aa, Homo Sapiens
YISPNMERGR

SEQ ID NO: 8838 - protein, 10 aa, Homo Sapiens
RWRFDATLEI

SEQ ID NO: 8839 - protein, 10 aa, Homo Sapiens
FDATLEIIVV

SEQ ID NO: 8840 - protein, 10 aa, Homo Sapiens
HSSHEPLPLA

SEQ ID NO: 8841 - protein, 10 aa, Homo Sapiens
LAYAVLYLTC

SEQ ID NO: 8842 - protein, 10 aa, Homo Sapiens
DISLDCDLNC

SEQ ID NO: 8843 - protein, 10 aa, Homo Sapiens
CDQHVHCLQD

SEQ ID NO: 8844 - protein, 10 aa, Homo Sapiens
HVHCLQDLED

SEQ ID NO: 8845 - protein, 10 aa, Homo Sapiens
HTSSYDAKRA

SEQ ID NO: 8846 - protein, 10 aa, Homo Sapiens
YEVPRLHGDE

SEQ ID NO: 8847 - protein, 10 aa, Homo Sapiens
SASPIFTDTV

SEQ ID NO: 8848 - protein, 10 aa, Homo Sapiens
ASPIFTDTVV

SEQ ID NO: 8849 - protein, 10 aa, Homo Sapiens
VFRVAPWIMT

SEQ ID NO: 8850 - protein, 10 aa, Homo Sapiens
WIMTPSTLPP

SEQ ID NO: 8851 - protein, 10 aa, Homo Sapiens
TPSTLPPLEV

SEQ ID NO: 8852 - protein, 10 aa, Homo Sapiens
NTCFVDAVAE

SEQ ID NO: 8853 - protein, 10 aa, Homo Sapiens
LTICPQAENR

SEQ ID NO: 8854 - protein, 10 aa, Homo Sapiens
DFPYKRILGP

SEQ ID NO: 8855 - protein, 10 aa, Homo Sapiens
EYPLGRILIG

SEQ ID NO: 8856 - protein, 10 aa, Homo Sapiens
GSSGRRVTQV

SEQ ID NO: 8857 - protein, 10 aa, Homo Sapiens
VQPPVELFVD

SEQ ID NO: 8858 - protein, 10 aa, Homo Sapiens
GKGFRMLLAS

SEQ ID NO: 8859 - protein, 10 aa, Homo Sapiens
LASPGACFKL

SEQ ID NO: 8860 - protein, 10 aa, Homo Sapiens
QVLSNKDLIN

SEQ ID NO: 8861 - protein, 10 aa, Homo Sapiens
REVLKRELGL

SEQ ID NO: 8862 - protein, 10 aa, Homo Sapiens
DIIDIPQLFK

SEQ ID NO: 8863 - protein, 10 aa, Homo Sapiens
EEKVRSLLEP

SEQ ID NO: 8864 - protein, 10 aa, Homo Sapiens
RSLLEPLGLH

SEQ ID NO: 8865 - protein, 10 aa, Homo Sapiens
GTNVCRKPFS

SEQ ID NO: 8866 - protein, 10 aa, Homo Sapiens
VSLEHPTSAV

SEQ ID NO: 8867 - protein, 10 aa, Homo Sapiens
TSAVCVAGVE

SEQ ID NO: 8868 - protein, 10 aa, Homo Sapiens
ISPNMERGRE

SEQ ID NO: 8869 - protein, 10 aa, Homo Sapiens
EPLPLAYAVL

SEQ ID NO: 8870 - protein, 10 aa, Homo Sapiens
YLTCVDISLD

SEQ ID NO: 8871 - protein, 10 aa, Homo Sapiens
VWGPSGYGGI

SEQ ID NO: 8872 - protein, 10 aa, Homo Sapiens
MSVMVLRTQG

SEQ ID NO: 8873 - protein, 10 aa, Homo Sapiens
ICGPEDVCEA

SEQ ID NO: 8874 - protein, 10 aa, Homo Sapiens
SFPDAGFTGL

SEQ ID NO: 8875 - protein, 10 aa, Homo Sapiens
SGLDSFGNLE

SEQ ID NO: 8876 - protein, 10 aa, Homo Sapiens
DSFGNLEVSP

SEQ ID NO: 8877 - protein, 10 aa, Homo Sapiens
EVSPPVVANG

SEQ ID NO: 8878 - protein, 10 aa, Homo Sapiens
SPPVVANGKE

SEQ ID NO: 8879 - protein, 10 aa, Homo Sapiens
VPAPDGKGFR

SEQ ID NO: 8880 - protein, 10 aa, Homo Sapiens
QSCIDWNREV

SEQ ID NO: 8881 - protein, 10 aa, Homo Sapiens
GLAECDIIDI

SEQ ID NO: 8882 - protein, 10 aa, Homo Sapiens
AECDIIDIPQ

SEQ ID NO: 8883 - protein, 10 aa, Homo Sapiens
PFGPIINGCC

SEQ ID NO: 8884 - protein, 10 aa, Homo Sapiens
SLQRIVRVSL

SEQ ID NO: 8885 - protein, 10 aa, Homo Sapiens
LEHPTSAVCV

SEQ ID NO: 8886 - protein, 10 aa, Homo Sapiens
TPGVDIYISP

SEQ ID NO: 8887 - protein, 10 aa, Homo Sapiens
VMNSPSNDLN

SEQ ID NO: 8888 - protein, 10 aa, Homo Sapiens
NSPSNDLNDS

SEQ ID NO: 8889 - protein, 10 aa, Homo Sapiens
PSNDLNDSHV

SEQ ID NO: 8890 - protein, 10 aa, Homo Sapiens
DSHVQISYHS

SEQ ID NO: 8891 - protein, 10 aa, Homo Sapiens
ISYHSSHEPL

SEQ ID NO: 8892 - protein, 10 aa, Homo Sapiens
SYHSSHEPLP

SEQ ID NO: 8893 - protein, 10 aa, Homo Sapiens
LYLTCVDISL

SEQ ID NO: 8894 - protein, 10 aa, Homo Sapiens
ISLDCDLNCE

SEQ ID NO: 8895 - protein, 10 aa, Homo Sapiens
PSCDVQDNCD

SEQ ID NO: 8896 - protein, 10 aa, Homo Sapiens
TQGPAALFDD

SEQ ID NO: 8897 - protein, 10 aa, Homo Sapiens
TSSYDAKRAQ

SEQ ID NO: 8898 - protein, 10 aa, Homo Sapiens
AKRAQVFHIC

SEQ ID NO: 8899 - protein, 10 aa, Homo Sapiens
KRAQVFHICG

SEQ ID NO: 8900 - protein, 10 aa, Homo Sapiens
YRHVLGQDKV

SEQ ID NO: 8901 - protein, 10 aa, Homo Sapiens
DAGFTGLISF

SEQ ID NO: 8902 - protein, 10 aa, Homo Sapiens
GLISFHVTLL

SEQ ID NO: 8903 - protein, 10 aa, Homo Sapiens
DSNEDFSASP

SEQ ID NO: 8904 - protein, 10 aa, Homo Sapiens
EDFSASPIFT

SEQ ID NO: 8905 - protein, 10 aa, Homo Sapiens
RVAPWIMTPS

SEQ ID NO: 8906 - protein, 10 aa, Homo Sapiens
IMTPSTLPPL

SEQ ID NO: 8907 - protein, 10 aa, Homo Sapiens
VRNNTCFVDA

SEQ ID NO: 8908 - protein, 10 aa, Homo Sapiens
ELARKAGCKL

SEQ ID NO: 8909 - protein, 10 aa, Homo Sapiens
KAGCKLTICP

SEQ ID NO: 8910 - protein, 10 aa, Homo Sapiens
TICPQAENRN

SEQ ID NO: 8911 - protein, 10 aa, Homo Sapiens
ENRNDRWIQD

SEQ ID NO: 8912 - protein, 10 aa, Homo Sapiens
YVQAPHKTLP

SEQ ID NO: 8913 - protein, 10 aa, Homo Sapiens
RILGPDFGYV

SEQ ID NO: 8914 - protein, 10 aa, Homo Sapiens
RSVSGLDSFG

SEQ ID NO: 8915 - protein, 10 aa, Homo Sapiens
VANGKEYPLG

SEQ ID NO: 8916 - protein, 10 aa, Homo Sapiens
GNLPGSSGRR

SEQ ID NO: 8917 - protein, 10 aa, Homo Sapiens
LSFVPAPDGK

SEQ ID NO: 8918 - protein, 10 aa, Homo Sapiens
QKCGHGRALL

SEQ ID NO: 8919 - protein, 10 aa, Homo Sapiens
EQVKTISINQ

SEQ ID NO: 8920 - protein, 10 aa, Homo Sapiens
ISINQVLSNK

SEQ ID NO: 8921 - protein, 10 aa, Homo Sapiens
SINQVLSNKD

SEQ ID NO: 8922 - protein, 10 aa, Homo Sapiens
LSNKDLINYN

SEQ ID NO: 8923 - protein, 10 aa, Homo Sapiens
NKFVQSCIDW

SEQ ID NO: 8924 - protein, 10 aa, Homo Sapiens
SCIDWNREVL

SEQ ID NO: 8925 - protein, 10 aa, Homo Sapiens
LGLAECDIID

SEQ ID NO: 8926 - protein, 10 aa, Homo Sapiens
QLFKTERKKA

SEQ ID NO: 8927 - protein, 10 aa, Homo Sapiens
FFPDLVNMLV

SEQ ID NO: 8928 - protein, 10 aa, Homo Sapiens
PKPFGPIING

SEQ ID NO: 8929 - protein, 10 aa, Homo Sapiens
LQRIVRVSLE

SEQ ID NO: 8930 - protein, 10 aa, Homo Sapiens
SAVCVAGVET

SEQ ID NO: 8931 - protein, 10 aa, Homo Sapiens
VCVAGVETLV

SEQ ID NO: 8932 - protein, 10 aa, Homo Sapiens
TLVDIYGSVP

SEQ ID NO: 8933 - protein, 10 aa, Homo Sapiens
YGSVPEGTEM

SEQ ID NO: 8934 - protein, 10 aa, Homo Sapiens
SPNMERGRER

SEQ ID NO: 8935 - protein, 10 aa, Homo Sapiens
SPSNDLNDSH

SEQ ID NO: 8936 - protein, 10 aa, Homo Sapiens
PLAYAVLYLT

SEQ ID NO: 8937 - protein, 10 aa, Homo Sapiens
YAVLYLTCVD

SEQ ID NO: 8938 - protein, 10 aa, Homo Sapiens
VLYLTCVDIS

SEQ ID NO: 8939 - protein, 10 aa, Homo Sapiens
VDISLDCDLN

SEQ ID NO: 8940 - protein, 10 aa, Homo Sapiens
GRQDRNFVDK

SEQ ID NO: 8941 - protein, 10 aa, Homo Sapiens
YGGILLVNCD

SEQ ID NO: 8942 - protein, 10 aa, Homo Sapiens
QGPAALFDDH

SEQ ID NO: 8943 - protein, 10 aa, Homo Sapiens
AALFDDHKLV

SEQ ID NO: 8944 - protein, 10 aa, Homo Sapiens
VLGQDKVSYE

SEQ ID NO: 8945 - protein, 10 aa, Homo Sapiens
DDSNEDFSAS

SEQ ID NO: 8946 - protein, 10 aa, Homo Sapiens
SPIFTDTVVF

SEQ ID NO: 8947 - protein, 10 aa, Homo Sapiens
YVCRVRNNTC

SEQ ID NO: 8948 - protein, 10 aa, Homo Sapiens
YVTREPRDRS

SEQ ID NO: 8949 - protein, 10 aa, Homo Sapiens
SVSGLDSFGN

SEQ ID NO: 8950 - protein, 10 aa, Homo Sapiens
SFGNLEVSPP

SEQ ID NO: 8951 - protein, 10 aa, Homo Sapiens
GRILIGGNLP

SEQ ID NO: 8952 - protein, 10 aa, Homo Sapiens
NLPGSSGRRV

SEQ ID NO: 8953 - protein, 10 aa, Homo Sapiens
SGRRVTQVVR

SEQ ID NO: 8954 - protein, 10 aa, Homo Sapiens
FLHAQKVQPP

SEQ ID NO: 8955 - protein, 10 aa, Homo Sapiens
QKVQPPVELF

SEQ ID NO: 8956 - protein, 10 aa, Homo Sapiens
QPPVELFVDW

SEQ ID NO: 8957 - protein, 10 aa, Homo Sapiens
VDWLAVGHVD

SEQ ID NO: 8958 - protein, 10 aa, Homo Sapiens
AVGHVDEFLS

SEQ ID NO: 8959 - protein, 10 aa, Homo Sapiens
PDGKGFRMLL

SEQ ID NO: 8960 - protein, 10 aa, Homo Sapiens
GACFKLFQEK

SEQ ID NO: 8961 - protein, 10 aa, Homo Sapiens
ACFKLFQEKQ

SEQ ID NO: 8962 - protein, 10 aa, Homo Sapiens
FKLFQEKQKC

SEQ ID NO: 8963 - protein, 10 aa, Homo Sapiens
HGRALLFQGV

SEQ ID NO: 8964 - protein, 10 aa, Homo Sapiens
ALLFQGVVDD

SEQ ID NO: 8965 - protein, 10 aa, Homo Sapiens
VKTISINQVL

SEQ ID NO: 8966 - protein, 10 aa, Homo Sapiens
SNKDLINYNK

SEQ ID NO: 8967 - protein, 10 aa, Homo Sapiens
LINYNKFVQS

SEQ ID NO: 8968 - protein, 10 aa, Homo Sapiens
RKKATAFFPD

SEQ ID NO: 8969 - protein, 10 aa, Homo Sapiens
KKATAFFPDL

SEQ ID NO: 8970 - protein, 10 aa, Homo Sapiens
VHCGTNVCRK

SEQ ID NO: 8971 - protein, 10 aa, Homo Sapiens
NVCRKPFSFK

SEQ ID NO: 8972 - protein, 10 aa, Homo Sapiens
VCRKPFSFKW

SEQ ID NO: 8973 - protein, 10 aa, Homo Sapiens
EHPTSAVCVA

SEQ ID NO: 8974 - protein, 10 aa, Homo Sapiens
AVCVAGVETL

SEQ ID NO: 8975 - protein, 10 aa, Homo Sapiens
VDIYGSVPEG

SEQ ID NO: 8976 - protein, 10 aa, Homo Sapiens
SVPEGTEMFE

SEQ ID NO: 8977 - protein, 10 aa, Homo Sapiens
FEVYGTPGVD

SEQ ID NO: 8978 - protein, 10 aa, Homo Sapiens
EVYGTPGVDI

SEQ ID NO: 8979 - protein, 10 aa, Homo Sapiens
VDIYISPNME

SEQ ID NO: 8980 - protein, 10 aa, Homo Sapiens
MERGRERADT

SEQ ID NO: 8981 - protein, 10 aa, Homo Sapiens
ADTRRWRFDA

SEQ ID NO: 8982 - protein, 10 aa, Homo Sapiens
RRWRFDATLE

SEQ ID NO: 8983 - protein, 10 aa, Homo Sapiens
DLNDSHVQIS

SEQ ID NO: 8984 - protein, 10 aa, Homo Sapiens
SHVQISYHSS

SEQ ID NO: 8985 - protein, 10 aa, Homo Sapiens
DLNCEGRQDR

SEQ ID NO: 8986 - protein, 10 aa, Homo Sapiens
EGRQDRNFVD

SEQ ID NO: 8987 - protein, 10 aa, Homo Sapiens
VDKRQWVWGP

SEQ ID NO: 8988 - protein, 10 aa, Homo Sapiens
WVWGPSGYGG

SEQ ID NO: 8989 - protein, 10 aa, Homo Sapiens
LLVNCDRDDP

SEQ ID NO: 8990 - protein, 10 aa, Homo Sapiens
QHVHCLQDLE

SEQ ID NO: 8991 - protein, 10 aa, Homo Sapiens
SVMVLRTQGP

SEQ ID NO: 8992 - protein, 10 aa, Homo Sapiens
VLRTQGPAAL

SEQ ID NO: 8993 - protein, 10 aa, Homo Sapiens
LRTQGPAALF

SEQ ID NO: 8994 - protein, 10 aa, Homo Sapiens
PAALFDDHKL

SEQ ID NO: 8995 - protein, 10 aa, Homo Sapiens
VLHTSSYDAK

SEQ ID NO: 8996 - protein, 10 aa, Homo Sapiens
LHTSSYDAKR

SEQ ID NO: 8997 - protein, 10 aa, Homo Sapiens
YDAKRAQVFH

SEQ ID NO: 8998 - protein, 10 aa, Homo Sapiens
FHICGPEDVC

SEQ ID NO: 8999 - protein, 10 aa, Homo Sapiens
DVCEAYRHVL

SEQ ID NO: 9000 - protein, 10 aa, Homo Sapiens
AYRHVLGQDK

SEQ ID NO: 9001 - protein, 10 aa, Homo Sapiens
KVSYEVPRLH

SEQ ID NO: 9002 - protein, 10 aa, Homo Sapiens
RLHGDEERFF

SEQ ID NO: 9003 - protein, 10 aa, Homo Sapiens
EERFFVEGLS

SEQ ID NO: 9004 - protein, 10 aa, Homo Sapiens
SFHVTLLDDS

SEQ ID NO: 9005 - protein, 10 aa, Homo Sapiens
TLLDDSNEDF

SEQ ID NO: 9006 - protein, 10 aa, Homo Sapiens
PWIMTPSTLP

SEQ ID NO: 9007 - protein, 10 aa, Homo Sapiens
VYVCRVRNNT

SEQ ID NO: 9008 - protein, 10 aa, Homo Sapiens
VCRVRNNTCF

SEQ ID NO: 9009 - protein, 10 aa, Homo Sapiens
CFVDAVAELA

SEQ ID NO: 9010 - protein, 10 aa, Homo Sapiens
DAVAELARKA

SEQ ID NO: 9011 - protein, 10 aa, Homo Sapiens
AVAELARKAG

SEQ ID NO: 9012 - protein, 10 aa, Homo Sapiens
LARKAGCKLT

SEQ ID NO: 9013 - protein, 10 aa, Homo Sapiens
AENRNDRWIQ

SEQ ID NO: 9014 - protein, 10 aa, Homo Sapiens
RWIQDEMELG

SEQ ID NO: 9015 - protein, 10 aa, Homo Sapiens
LGYVQAPHKT

SEQ ID NO: 9016 - protein, 10 aa, Homo Sapiens
APHKTLPVVF

SEQ ID NO: 9017 - protein, 10 aa, Homo Sapiens
VVFDSPRNGE

SEQ ID NO: 9018 - protein, 10 aa, Homo Sapiens
SPRNGELQDF

SEQ ID NO: 9019 - protein, 10 aa, Homo Sapiens
GELQDFPYKR

SEQ ID NO: 9020 - protein, 10 aa, Homo Sapiens
YKRILGPDFG

SEQ ID NO: 9021 - protein, 10 aa, Homo Sapiens
ILIGGNLPGS

SEQ ID NO: 9022 - protein, 10 aa, Homo Sapiens
LPGSSGRRVT

SEQ ID NO: 9023 - protein, 10 aa, Homo Sapiens
ELFVDWLAVG

SEQ ID NO: 9024 - protein, 10 aa, Homo Sapiens
WLAVGHVDEF

SEQ ID NO: 9025 - protein, 10 aa, Homo Sapiens
FLSFVPAPDG

SEQ ID NO: 9026 - protein, 10 aa, Homo Sapiens
FVPAPDGKGF

SEQ ID NO: 9027 - protein, 10 aa, Homo Sapiens
MLLASPGACF

SEQ ID NO: 9028 - protein, 10 aa, Homo Sapiens
RALLFQGVVD

SEQ ID NO: 9029 - protein, 10 aa, Homo Sapiens
LLFQGVVDDE

SEQ ID NO: 9030 - protein, 10 aa, Homo Sapiens
GVVDDEQVKT

SEQ ID NO: 9031 - protein, 10 aa, Homo Sapiens
NQVLSNKDLI

SEQ ID NO: 9032 - protein, 10 aa, Homo Sapiens
DLINYNKFVQ

SEQ ID NO: 9033 - protein, 10 aa, Homo Sapiens
YNKFVQSCID

SEQ ID NO: 9034 - protein, 10 aa, Homo Sapiens
EVLKRELGLA

SEQ ID NO: 9035 - protein, 10 aa, Homo Sapiens
CDIIDIPQLF

SEQ ID NO: 9036 - protein, 10 aa, Homo Sapiens
PQLFKTERKK

SEQ ID NO: 9037 - protein, 10 aa, Homo Sapiens
KATAFFPDLV

SEQ ID NO: 9038 - protein, 10 aa, Homo Sapiens
PDLVNMLVLG

SEQ ID NO: 9039 - protein, 10 aa, Homo Sapiens
LVNMLVLGKH

SEQ ID NO: 9040 - protein, 10 aa, Homo Sapiens
VNMLVLGKHL

SEQ ID NO: 9041 - protein, 10 aa, Homo Sapiens
NMLVLGKHLG

SEQ ID NO: 9042 - protein, 10 aa, Homo Sapiens
LGKHLGIPKP

SEQ ID NO: 9043 - protein, 10 aa, Homo Sapiens
FGPIINGCCC

SEQ ID NO: 9044 - protein, 10 aa, Homo Sapiens
PIINGCCCLE

SEQ ID NO: 9045 - protein, 10 aa, Homo Sapiens
NGCCCLEEKV

SEQ ID NO: 9046 - protein, 10 aa, Homo Sapiens
KVRSLLEPLG

SEQ ID NO: 9047 - protein, 10 aa, Homo Sapiens
DDFTPYHMLH

SEQ ID NO: 9048 - protein, 10 aa, Homo Sapiens
PYHMLHGEVH

SEQ ID NO: 9049 - protein, 10 aa, Homo Sapiens
YHMLHGEVHC

SEQ ID NO: 9050 - protein, 10 aa, Homo Sapiens
MLHGEVHCGT

SEQ ID NO: 9051 - protein, 10 aa, Homo Sapiens
HCGTNVCRKP

SEQ ID NO: 9052 - protein, 10 aa, Homo Sapiens
VRVSLEHPTS

SEQ ID NO: 9053 - protein, 10 aa, Homo Sapiens
VAGVETLVDI

SEQ ID NO: 9054 - protein, 10 aa, Homo Sapiens
VETLVDIYGS

SEQ ID NO: 9055 - protein, 10 aa, Homo Sapiens
DIYGSVPEGT

SEQ ID NO: 9056 - protein, 10 aa, Homo Sapiens
EMFEVYGTPG

SEQ ID NO: 9057 - protein, 10 aa, Homo Sapiens
DIYISPNMER

SEQ ID NO: 9058 - protein, 10 aa, Homo Sapiens
PNMERGRERA

SEQ ID NO: 9059 - protein, 10 aa, Homo Sapiens
RERADTRRWR

SEQ ID NO: 9060 - protein, 10 aa, Homo Sapiens
ERADTRRWRF

SEQ ID NO: 9061 - protein, 10 aa, Homo Sapiens
DATLEIIVVM

SEQ ID NO: 9062 - protein, 10 aa, Homo Sapiens
EIIVVMNSPS

SEQ ID NO: 9063 - protein, 10 aa, Homo Sapiens
VVMNSPSNDL

SEQ ID NO: 9064 - protein, 10 aa, Homo Sapiens
VQISYHSSHE

SEQ ID NO: 9065 - protein, 10 aa, Homo Sapiens
AYAVLYLTCV

SEQ ID NO: 9066 - protein, 10 aa, Homo Sapiens
AVLYLTCVDI

SEQ ID NO: 9067 - protein, 10 aa, Homo Sapiens
CDLNCEGRQD

SEQ ID NO: 9068 - protein, 10 aa, Homo Sapiens
CEGRQDRNFV

SEQ ID NO: 9069 - protein, 10 aa, Homo Sapiens
RNFVDKRQWV

SEQ ID NO: 9070 - protein, 10 aa, Homo Sapiens
NFVDKRQWVW

SEQ ID NO: 9071 - protein, 10 aa, Homo Sapiens
KRQWVWGPSG

SEQ ID NO: 9072 - protein, 10 aa, Homo Sapiens
WGPSGYGGIL

SEQ ID NO: 9073 - protein, 10 aa, Homo Sapiens
GYGGILLVNC

SEQ ID NO: 9074 - protein, 10 aa, Homo Sapiens
GGILLVNCDR

SEQ ID NO: 9075 - protein, 10 aa, Homo Sapiens
ILLVNCDRDD

SEQ ID NO: 9076 - protein, 10 aa, Homo Sapiens
VNCDRDDPSC

SEQ ID NO: 9077 - protein, 10 aa, Homo Sapiens
DDPSCDVQDN

SEQ ID NO: 9078 - protein, 10 aa, Homo Sapiens
DNCDQHVHCL

SEQ ID NO: 9079 - protein, 10 aa, Homo Sapiens
VHCLQDLEDM

SEQ ID NO: 9080 - protein, 10 aa, Homo Sapiens
HCLQDLEDMS

SEQ ID NO: 9081 - protein, 10 aa, Homo Sapiens
CLQDLEDMSV

SEQ ID NO: 9082 - protein, 10 aa, Homo Sapiens
QDLEDMSVMV

SEQ ID NO: 9083 - protein, 10 aa, Homo Sapiens
VMVLRTQGPA

SEQ ID NO: 9084 - protein, 10 aa, Homo Sapiens
MVLRTQGPAA

SEQ ID NO: 9085 - protein, 10 aa, Homo Sapiens
KLVLHTSSYD

SEQ ID NO: 9086 - protein, 10 aa, Homo Sapiens
DAKRAQVFHI

SEQ ID NO: 9087 - protein, 10 aa, Homo Sapiens
AQVFHICGPE

SEQ ID NO: 9088 - protein, 10 aa, Homo Sapiens
QVFHICGPED

SEQ ID NO: 9089 - protein, 10 aa, Homo Sapiens
VFHICGPEDV

SEQ ID NO: 9090 - protein, 10 aa, Homo Sapiens
HICGPEDVCE

SEQ ID NO: 9091 - protein, 10 aa, Homo Sapiens
RHVLGQDKVS

SEQ ID NO: 9092 - protein, 10 aa, Homo Sapiens
DKVSYEVPRL

SEQ ID NO: 9093 - protein, 10 aa, Homo Sapiens
EVPRLHGDEE

SEQ ID NO: 9094 - protein, 10 aa, Homo Sapiens
VPRLHGDEER

SEQ ID NO: 9095 - protein, 10 aa, Homo Sapiens
LHGDEERFFV

SEQ ID NO: 9096 - protein, 10 aa, Homo Sapiens
FFVEGLSFPD

SEQ ID NO: 9097 - protein, 10 aa, Homo Sapiens
VEGLSFPDAG

SEQ ID NO: 9098 - protein, 10 aa, Homo Sapiens
GLSFPDAGFT

SEQ ID NO: 9099 - protein, 10 aa, Homo Sapiens
AGFTGLISFH

SEQ ID NO: 9100 - protein, 10 aa, Homo Sapiens
GFTGLISFHV

SEQ ID NO: 9101 - protein, 10 aa, Homo Sapiens
FHVTLLDDSN

SEQ ID NO: 9102 - protein, 10 aa, Homo Sapiens
PIFTDTVVFR

SEQ ID NO: 9103 - protein, 10 aa, Homo Sapiens
IFTDTVVFRV

SEQ ID NO: 9104 - protein, 10 aa, Homo Sapiens
TDTVVFRVAP

SEQ ID NO: 9105 - protein, 10 aa, Homo Sapiens
VVFRVAPWIM

SEQ ID NO: 9106 - protein, 10 aa, Homo Sapiens
FRVAPWIMTP

SEQ ID NO: 9107 - protein, 10 aa, Homo Sapiens
VAPWIMTPST

SEQ ID NO: 9108 - protein, 10 aa, Homo Sapiens
APWIMTPSTL

SEQ ID NO: 9109 - protein, 10 aa, Homo Sapiens
PPLEVYVCRV

SEQ ID NO: 9110 - protein, 10 aa, Homo Sapiens
LEVYVCRVRN

SEQ ID NO: 9111 - protein, 10 aa, Homo Sapiens
EVYVCRVRNN

SEQ ID NO: 9112 - protein, 10 aa, Homo Sapiens
RVRNNTCFVD

SEQ ID NO: 9113 - protein, 10 aa, Homo Sapiens
RNNTCFVDAV

SEQ ID NO: 9114 - protein, 10 aa, Homo Sapiens
NNTCFVDAVA

SEQ ID NO: 9115 - protein, 10 aa, Homo Sapiens
TCFVDAVAEL

SEQ ID NO: 9116 - protein, 10 aa, Homo Sapiens
VDAVAELARK

SEQ ID NO: 9117 - protein, 10 aa, Homo Sapiens
AELARKAGCK

SEQ ID NO: 9118 - protein, 10 aa, Homo Sapiens
RKAGCKLTIC

SEQ ID NO: 9119 - protein, 10 aa, Homo Sapiens
AGCKLTICPQ

SEQ ID NO: 9120 - protein, 10 aa, Homo Sapiens
KLTICPQAEN

SEQ ID NO: 9121 - protein, 10 aa, Homo Sapiens
ICPQAENRND

SEQ ID NO: 9122 - protein, 10 aa, Homo Sapiens
CPQAENRNDR

SEQ ID NO: 9123 - protein, 10 aa, Homo Sapiens
PQAENRNDRW

SEQ ID NO: 9124 - protein, 10 aa, Homo Sapiens
NDRWIQDEME

SEQ ID NO: 9125 - protein, 10 aa, Homo Sapiens
MELGYVQAPH

SEQ ID NO: 9126 - protein, 10 aa, Homo Sapiens
ELGYVQAPHK

SEQ ID NO: 9127 - protein, 10 aa, Homo Sapiens
QAPHKTLPVV

SEQ ID NO: 9128 - protein, 10 aa, Homo Sapiens
PHKTLPVVFD

SEQ ID NO: 9129 - protein, 10 aa, Homo Sapiens
HKTLPVVFDS

SEQ ID NO: 9130 - protein, 10 aa, Homo Sapiens
TLPVVFDSPR

SEQ ID NO: 9131 - protein, 10 aa, Homo Sapiens
PRNGELQDFP

SEQ ID NO: 9132 - protein, 10 aa, Homo Sapiens
ELQDFPYKRI

SEQ ID NO: 9133 - protein, 10 aa, Homo Sapiens
FPYKRILGPD

SEQ ID NO: 9134 - protein, 10 aa, Homo Sapiens
PYKRILGPDF

SEQ ID NO: 9135 - protein, 10 aa, Homo Sapiens
PDFGYVTREP

SEQ ID NO: 9136 - protein, 10 aa, Homo Sapiens
DFGYVTREPR

SEQ ID NO: 9137 - protein, 10 aa, Homo Sapiens
FGYVTREPRD

SEQ ID NO: 9138 - protein, 10 aa, Homo Sapiens
EPRDRSVSGL

SEQ ID NO: 9139 - protein, 10 aa, Homo Sapiens
LDSFGNLEVS

SEQ ID NO: 9140 - protein, 10 aa, Homo Sapiens
FGNLEVSPPV

SEQ ID NO: 9141 - protein, 10 aa, Homo Sapiens
GNLEVSPPVV

SEQ ID NO: 9142 - protein, 10 aa, Homo Sapiens
LEVSPPVVAN

SEQ ID NO: 9143 - protein, 10 aa, Homo Sapiens
VVANGKEYPL

SEQ ID NO: 9144 - protein, 10 aa, Homo Sapiens
PLGRILIGGN

SEQ ID NO: 9145 - protein, 10 aa, Homo Sapiens
LGRILIGGNL

SEQ ID NO: 9146 - protein, 10 aa, Homo Sapiens
LIGGNLPGSS

SEQ ID NO: 9147 - protein, 10 aa, Homo Sapiens
IGGNLPGSSG

SEQ ID NO: 9148 - protein, 10 aa, Homo Sapiens
PGSSGRRVTQ

SEQ ID NO: 9149 - protein, 10 aa, Homo Sapiens
GRRVTQVVRD

SEQ ID NO: 9150 - protein, 10 aa, Homo Sapiens
RRVTQVVRDF

SEQ ID NO: 9151 - protein, 10 aa, Homo Sapiens
RVTQVVRDFL

SEQ ID NO: 9152 - protein, 10 aa, Homo Sapiens
VVRDFLHAQK

SEQ ID NO: 9153 - protein, 10 aa, Homo Sapiens
RDFLHAQKVQ

SEQ ID NO: 9154 - protein, 10 aa, Homo Sapiens
HAQKVQPPVE

SEQ ID NO: 9155 - protein, 10 aa, Homo Sapiens
AQKVQPPVEL

SEQ ID NO: 9156 - protein, 10 aa, Homo Sapiens
PPVELFVDWL

SEQ ID NO: 9157 - protein, 10 aa, Homo Sapiens
LAVGHVDEFL

SEQ ID NO: 9158 - protein, 10 aa, Homo Sapiens
DEFLSFVPAP

SEQ ID NO: 9159 - protein, 10 aa, Homo Sapiens
PAPDGKGFRM

SEQ ID NO: 9160 - protein, 10 aa, Homo Sapiens
FRMLLASPGA

SEQ ID NO: 9161 - protein, 10 aa, Homo Sapiens
LLASPGACFK

SEQ ID NO: 9162 - protein, 10 aa, Homo Sapiens
KLFQEKQKCG

SEQ ID NO: 9163 - protein, 10 aa, Homo Sapiens
QEKQKCGHGR

SEQ ID NO: 9164 - protein, 10 aa, Homo Sapiens
KQKCGHGRAL

SEQ ID NO: 9165 - protein, 10 aa, Homo Sapiens
GRALLFQGVV

SEQ ID NO: 9166 - protein, 10 aa, Homo Sapiens
LFQGVVDDEQ

SEQ ID NO: 9167 - protein, 10 aa, Homo Sapiens
FQGVVDDEQV

SEQ ID NO: 9168 - protein, 10 aa, Homo Sapiens
QGVVDDEQVK

SEQ ID NO: 9169 - protein, 10 aa, Homo Sapiens
INQVLSNKDL

SEQ ID NO: 9170 - protein, 10 aa, Homo Sapiens
KDLINYNKFV

SEQ ID NO: 9171 - protein, 10 aa, Homo Sapiens
INYNKFVQSC

SEQ ID NO: 9172 - protein, 10 aa, Homo Sapiens
FVQSCIDWNR

SEQ ID NO: 9173 - protein, 10 aa, Homo Sapiens
VQSCIDWNRE

SEQ ID NO: 9174 - protein, 10 aa, Homo Sapiens
RELGLAECDI

SEQ ID NO: 9175 - protein, 10 aa, Homo Sapiens
ELGLAECDII

SEQ ID NO: 9176 - protein, 10 aa, Homo Sapiens
FKTERKKATA

SEQ ID NO: 9177 - protein, 10 aa, Homo Sapiens
LVLGKHLGIP

SEQ ID NO: 9178 - protein, 10 aa, Homo Sapiens
KHLGIPKPFG

SEQ ID NO: 9179 - protein, 10 aa, Homo Sapiens
HLGIPKPFGP

SEQ ID NO: 9180 - protein, 10 aa, Homo Sapiens
GIPKPFGPII

SEQ ID NO: 9181 - protein, 10 aa, Homo Sapiens
KPFGPIINGC

SEQ ID NO: 9182 - protein, 10 aa, Homo Sapiens
GCCCLEEKVR

SEQ ID NO: 9183 - protein, 10 aa, Homo Sapiens
CCLEEKVRSL

SEQ ID NO: 9184 - protein, 10 aa, Homo Sapiens
EPLGLHCTFI

SEQ ID NO: 9185 - protein, 10 aa, Homo Sapiens
PLGLHCTFID

SEQ ID NO: 9186 - protein, 10 aa, Homo Sapiens
GLHCTFIDDF

SEQ ID NO: 9187 - protein, 10 aa, Homo Sapiens
HMLHGEVHCG

SEQ ID NO: 9188 - protein, 10 aa, Homo Sapiens
GEVHCGTNVC

SEQ ID NO: 9189 - protein, 10 aa, Homo Sapiens
EVHCGTNVCR

SEQ ID NO: 9190 - protein, 10 aa, Homo Sapiens
CGTNVCRKPF

SEQ ID NO: 9191 - protein, 10 aa, Homo Sapiens
PFSFKWWNMV

SEQ ID NO: 9192 - protein, 10 aa, Homo Sapiens
PSTLAPLEVY

SEQ ID NO: 9193 - protein, 10 aa, Homo Sapiens
MTPSTLAPLE

SEQ ID NO: 9194 - protein, 10 aa, Homo Sapiens
STLAPLEVYV

SEQ ID NO: 9195 - protein, 10 aa, Homo Sapiens
TLAPLEVYVC

SEQ ID NO: 9196 - protein, 10 aa, Homo Sapiens
WIMTPSTLAP

SEQ ID NO: 9197 - protein, 10 aa, Homo Sapiens
TPSTLAPLEV

SEQ ID NO: 9198 - protein, 10 aa, Homo Sapiens
IMTPSTLAPL

SEQ ID NO: 9199 - protein, 10 aa, Homo Sapiens
PWIMTPSTLA

SEQ ID NO: 9200 - protein, 10 aa, Homo Sapiens
APLEVYVCRV

SEQ ID NO: 9201 - protein, 10 aa, Homo Sapiens
VPDGKGFRML

SEQ ID NO: 9202 - protein, 10 aa, Homo Sapiens
VDEFLSFVPV

SEQ ID NO: 9203 - protein, 10 aa, Homo Sapiens
SFVPVPDGKG

SEQ ID NO: 9204 - protein, 10 aa, Homo Sapiens
VPVPDGKGFR

SEQ ID NO: 9205 - protein, 10 aa, Homo Sapiens
LSFVPVPDGK

SEQ ID NO: 9206 - protein, 10 aa, Homo Sapiens
FLSFVPVPDG

SEQ ID NO: 9207 - protein, 10 aa, Homo Sapiens
DEFLSFVPVP

SEQ ID NO: 9208 - protein, 10 aa, Homo Sapiens
FVPVPDGKGF

SEQ ID NO: 9209 - protein, 10 aa, Homo Sapiens
PVPDGKGFRM

SEQ ID NO: 9210 - protein, 10 aa, Homo Sapiens
GLISFHVTLL

SEQ ID NO: 9211 - protein, 10 aa, Homo Sapiens
GLAECDIIDI

SEQ ID NO: 9212 - protein, 10 aa, Homo Sapiens
SLQRIVRVSL

SEQ ID NO: 9213 - protein, 10 aa, Homo Sapiens
IMTPSTLPPL

SEQ ID NO: 9214 - protein, 10 aa, Homo Sapiens
ALFDDHKLVL

SEQ ID NO: 9215 - protein, 10 aa, Homo Sapiens
VLRTQGPAAL

SEQ ID NO: 9216 - protein, 10 aa, Homo Sapiens
GLDSFGNLEV

SEQ ID NO: 9217 - protein, 10 aa, Homo Sapiens
CLQDLEDMSV

SEQ ID NO: 9218 - protein, 10 aa, Homo Sapiens
DLEDMSVMVL

SEQ ID NO: 9219 - protein, 10 aa, Homo Sapiens
AVCVAGVETL

SEQ ID NO: 9220 - protein, 10 aa, Homo Sapiens
STLPPLEVYV

SEQ ID NO: 9221 - protein, 10 aa, Homo Sapiens
RILGPDFGYV

SEQ ID NO: 9222 - protein, 10 aa, Homo Sapiens
ILIGGNLPGS

SEQ ID NO: 9223 - protein, 10 aa, Homo Sapiens
NLPGSSGRRV

SEQ ID NO: 9224 - protein, 10 aa, Homo Sapiens
LLEPLGLHCT

SEQ ID NO: 9225 - protein, 10 aa, Homo Sapiens
ELARKAGCKL

SEQ ID NO: 9226 - protein, 10 aa, Homo Sapiens
CLEEKVRSLL

SEQ ID NO: 9227 - protein, 10 aa, Homo Sapiens
SASPIFTDTV

SEQ ID NO: 9228 - protein, 10 aa, Homo Sapiens
LASPGACFKL

SEQ ID NO: 9229 - protein, 10 aa, Homo Sapiens
IIDIPQLFKT

SEQ ID NO: 9230 - protein, 10 aa, Homo Sapiens
AFFPDLVNML

SEQ ID NO: 9231 - protein, 10 aa, Homo Sapiens
MLVLGKHLGI

SEQ ID NO: 9232 - protein, 10 aa, Homo Sapiens
CCLEEKVRSL

SEQ ID NO: 9233 - protein, 10 aa, Homo Sapiens
VAGVETLVDI

SEQ ID NO: 9234 - protein, 10 aa, Homo Sapiens
LPLAYAVLYL

SEQ ID NO: 9235 - protein, 10 aa, Homo Sapiens
TCFVDAVAEL

SEQ ID NO: 9236 - protein, 10 aa, Homo Sapiens
QAPHKTLPVV

SEQ ID NO: 9237 - protein, 10 aa, Homo Sapiens
ILGPDFGYVT

SEQ ID NO: 9238 - protein, 10 aa, Homo Sapiens
VTREPRDRSV

SEQ ID NO: 9239 - protein, 10 aa, Homo Sapiens
FVDWLAVGHV

SEQ ID NO: 9240 - protein, 10 aa, Homo Sapiens
ALLFQGVVDD

SEQ ID NO: 9241 - protein, 10 aa, Homo Sapiens
VVDDEQVKTI

SEQ ID NO: 9242 - protein, 10 aa, Homo Sapiens
PTSAVCVAGV

SEQ ID NO: 9243 - protein, 10 aa, Homo Sapiens
AYAVLYLTCV

SEQ ID NO: 9244 - protein, 10 aa, Homo Sapiens
IQDEMELGYV

SEQ ID NO: 9245 - protein, 10 aa, Homo Sapiens
VVANGKEYPL

SEQ ID NO: 9246 - protein, 10 aa, Homo Sapiens
KVQPPVELFV

SEQ ID NO: 9247 - protein, 10 aa, Homo Sapiens
WLAVGHVDEF

SEQ ID NO: 9248 - protein, 10 aa, Homo Sapiens
LAVGHVDEFL

SEQ ID NO: 9249 - protein, 10 aa, Homo Sapiens
QVKTISINQV

SEQ ID NO: 9250 - protein, 10 aa, Homo Sapiens
GIPKPFGPII

SEQ ID NO: 9251 - protein, 10 aa, Homo Sapiens
FDATLEIIVV

SEQ ID NO: 9252 - protein, 10 aa, Homo Sapiens
VVMNSPSNDL

SEQ ID NO: 9253 - protein, 10 aa, Homo Sapiens
PLAYAVLYLT

SEQ ID NO: 9254 - protein, 10 aa, Homo Sapiens
AVLYLTCVDI

SEQ ID NO: 9255 - protein, 10 aa, Homo Sapiens
TLPPLEVYVC

SEQ ID NO: 9256 - protein, 10 aa, Homo Sapiens
GSSGRRVTQV

SEQ ID NO: 9257 - protein, 10 aa, Homo Sapiens
LLFQGVVDDE

SEQ ID NO: 9258 - protein, 10 aa, Homo Sapiens
SLLEPLGLHC

SEQ ID NO: 9259 - protein, 10 aa, Homo Sapiens
MLHGEVHCGT

SEQ ID NO: 9260 - protein, 10 aa, Homo Sapiens
VSLEHPTSAV

SEQ ID NO: 9261 - protein, 10 aa, Homo Sapiens
LEHPTSAVCV

SEQ ID NO: 9262 - protein, 10 aa, Homo Sapiens
ATLEIIVVMN

SEQ ID NO: 9263 - protein, 10 aa, Homo Sapiens
VLYLTCVDIS

SEQ ID NO: 9264 - protein, 10 aa, Homo Sapiens
LYLTCVDISL

SEQ ID NO: 9265 - protein, 10 aa, Homo Sapiens
QDLEDMSVMV

SEQ ID NO: 9266 - protein, 10 aa, Homo Sapiens
PAALFDDHKL

SEQ ID NO: 9267 - protein, 10 aa, Homo Sapiens
AALFDDHKLV

SEQ ID NO: 9268 - protein, 10 aa, Homo Sapiens
SSYDAKRAQV

SEQ ID NO: 9269 - protein, 10 aa, Homo Sapiens
DVCEAYRHVL

SEQ ID NO: 9270 - protein, 10 aa, Homo Sapiens
LGQDKVSYEV

SEQ ID NO: 9271 - protein, 10 aa, Homo Sapiens
TGLISFHVTL

SEQ ID NO: 9272 - protein, 10 aa, Homo Sapiens
IFTDTVVFRV

SEQ ID NO: 9273 - protein, 10 aa, Homo Sapiens
RNNTCFVDAV

SEQ ID NO: 9274 - protein, 10 aa, Homo Sapiens
VQAPHKTLPV

SEQ ID NO: 9275 - protein, 10 aa, Homo Sapiens
GNLEVSPPVV

SEQ ID NO: 9276 - protein, 10 aa, Homo Sapiens
GHVDEFLSFV

SEQ ID NO: 9277 - protein, 10 aa, Homo Sapiens
QLFKTERKKA

SEQ ID NO: 9278 - protein, 10 aa, Homo Sapiens
IINGCCCLEE

SEQ ID NO: 9279 - protein, 10 aa, Homo Sapiens
ETLVDIYGSV

SEQ ID NO: 9280 - protein, 10 aa, Homo Sapiens
DIYGSVPEGT

SEQ ID NO: 9281 - protein, 10 aa, Homo Sapiens
DLNDSHVQIS

SEQ ID NO: 9282 - protein, 10 aa, Homo Sapiens
YLTCVDISLD

SEQ ID NO: 9283 - protein, 10 aa, Homo Sapiens
DNCDQHVHCL

SEQ ID NO: 9284 - protein, 10 aa, Homo Sapiens
VLGQDKVSYE

SEQ ID NO: 9285 - protein, 10 aa, Homo Sapiens
APWIMTPSTL

SEQ ID NO: 9286 - protein, 10 aa, Homo Sapiens
PPLEVYVCRV

SEQ ID NO: 9287 - protein, 10 aa, Homo Sapiens
ELQDFPYKRI

SEQ ID NO: 9288 - protein, 10 aa, Homo Sapiens
NLEVSPPVVA

SEQ ID NO: 9289 - protein, 10 aa, Homo Sapiens
FLHAQKVQPP

SEQ ID NO: 9290 - protein, 10 aa, Homo Sapiens
LHAQKVQPPV

SEQ ID NO: 9291 - protein, 10 aa, Homo Sapiens
AQKVQPPVEL

SEQ ID NO: 9292 - protein, 10 aa, Homo Sapiens
TISINQVLSN

SEQ ID NO: 9293 - protein, 10 aa, Homo Sapiens
VLSNKDLINY

SEQ ID NO: 9294 - protein, 10 aa, Homo Sapiens
SCIDWNREVL

SEQ ID NO: 9295 - protein, 10 aa, Homo Sapiens
ELGLAECDII

SEQ ID NO: 9296 - protein, 10 aa, Homo Sapiens
DLVNMLVLGK

SEQ ID NO: 9297 - protein, 10 aa, Homo Sapiens
GLHCTFIDDF

SEQ ID NO: 9298 - protein, 10 aa, Homo Sapiens
FIDDFTPYHM

SEQ ID NO: 9299 - protein, 10 aa, Homo Sapiens
HMLHGEVHCG

SEQ ID NO: 9300 - protein, 10 aa, Homo Sapiens
SAVCVAGVET

SEQ ID NO: 9301 - protein, 10 aa, Homo Sapiens
VPEGTEMFEV

SEQ ID NO: 9302 - protein, 10 aa, Homo Sapiens
GTEMFEVYGT

SEQ ID NO: 9303 - protein, 10 aa, Homo Sapiens
EVYGTPGVDI

SEQ ID NO: 9304 - protein, 10 aa, Homo Sapiens
TRRWRFDATL

SEQ ID NO: 9305 - protein, 10 aa, Homo Sapiens
WRFDATLEII

SEQ ID NO: 9306 - protein, 10 aa, Homo Sapiens
CVDISLDCDL

SEQ ID NO: 9307 - protein, 10 aa, Homo Sapiens
SLDCDLNCEG

SEQ ID NO: 9308 - protein, 10 aa, Homo Sapiens
ILLVNCDRDD

SEQ ID NO: 9309 - protein, 10 aa, Homo Sapiens
DVQDNCDQHV

SEQ ID NO: 9310 - protein, 10 aa, Homo Sapiens
DAKRAQVFHI

SEQ ID NO: 9311 - protein, 10 aa, Homo Sapiens
ICGPEDVCEA

SEQ ID NO: 9312 - protein, 10 aa, Homo Sapiens
YRHVLGQDKV

SEQ ID NO: 9313 - protein, 10 aa, Homo Sapiens
DKVSYEVPRL

SEQ ID NO: 9314 - protein, 10 aa, Homo Sapiens
GLSFPDAGFT

SEQ ID NO: 9315 - protein, 10 aa, Homo Sapiens
SFPDAGFTGL

SEQ ID NO: 9316 - protein, 10 aa, Homo Sapiens
KLTICPQAEN

SEQ ID NO: 9317 - protein, 10 aa, Homo Sapiens
LIGGNLPGSS

SEQ ID NO: 9318 - protein, 10 aa, Homo Sapiens
VELFVDWLAV

SEQ ID NO: 9319 - protein, 10 aa, Homo Sapiens
ELFVDWLAVG

SEQ ID NO: 9320 - protein, 10 aa, Homo Sapiens
APDGKGFRML

SEQ ID NO: 9321 - protein, 10 aa, Homo Sapiens
MLLASPGACF

SEQ ID NO: 9322 - protein, 10 aa, Homo Sapiens
LLASPGACFK

SEQ ID NO: 9323 - protein, 10 aa, Homo Sapiens
QKCGHGRALL

SEQ ID NO: 9324 - protein, 10 aa, Homo Sapiens
GVVDDEQVKT

SEQ ID NO: 9325 - protein, 10 aa, Homo Sapiens
SINQVLSNKD

SEQ ID NO: 9326 - protein, 10 aa, Homo Sapiens
WNREVLKREL

SEQ ID NO: 9327 - protein, 10 aa, Homo Sapiens
KKATAFFPDL

SEQ ID NO: 9328 - protein, 10 aa, Homo Sapiens
KATAFFPDLV

SEQ ID NO: 9329 - protein, 10 aa, Homo Sapiens
TAFFPDLVNM

SEQ ID NO: 9330 - protein, 10 aa, Homo Sapiens
LVLGKHLGIP

SEQ ID NO: 9331 - protein, 10 aa, Homo Sapiens
LGIPKPFGPI

SEQ ID NO: 9332 - protein, 10 aa, Homo Sapiens
SLEHPTSAVC

SEQ ID NO: 9333 - protein, 10 aa, Homo Sapiens
YISPNMERGR

SEQ ID NO: 9334 - protein, 10 aa, Homo Sapiens
TLEIIVVMNS

SEQ ID NO: 9335 - protein, 10 aa, Homo Sapiens
IIVVMNSPSN

SEQ ID NO: 9336 - protein, 10 aa, Homo Sapiens
ISYHSSHEPL

SEQ ID NO: 9337 - protein, 10 aa, Homo Sapiens
YHSSHEPLPL

SEQ ID NO: 9338 - protein, 10 aa, Homo Sapiens
SHEPLPLAYA

SEQ ID NO: 9339 - protein, 10 aa, Homo Sapiens
EPLPLAYAVL

SEQ ID NO: 9340 - protein, 10 aa, Homo Sapiens
GPSGYGGILL

SEQ ID NO: 9341 - protein, 10 aa, Homo Sapiens
DQHVHCLQDL

SEQ ID NO: 9342 - protein, 10 aa, Homo Sapiens
DMSVMVLRTQ

SEQ ID NO: 9343 - protein, 10 aa, Homo Sapiens
VMVLRTQGPA

SEQ ID NO: 9344 - protein, 10 aa, Homo Sapiens
LVLHTSSYDA

SEQ ID NO: 9345 - protein, 10 aa, Homo Sapiens
LHGDEERFFV

SEQ ID NO: 9346 - protein, 10 aa, Homo Sapiens
DEERFFVEGL

SEQ ID NO: 9347 - protein, 10 aa, Homo Sapiens
TLLDDSNEDF

SEQ ID NO: 9348 - protein, 10 aa, Homo Sapiens
LLDDSNEDFS

SEQ ID NO: 9349 - protein, 10 aa, Homo Sapiens
TPSTLPPLEV

SEQ ID NO: 9350 - protein, 10 aa, Homo Sapiens
VFDSPRNGEL

SEQ ID NO: 9351 - protein, 10 aa, Homo Sapiens
EPRDRSVSGL

SEQ ID NO: 9352 - protein, 10 aa, Homo Sapiens
FGNLEVSPPV

SEQ ID NO: 9353 - protein, 10 aa, Homo Sapiens
NGKEYPLGRI

SEQ ID NO: 9354 - protein, 10 aa, Homo Sapiens
RVTQVVRDFL

SEQ ID NO: 9355 - protein, 10 aa, Homo Sapiens
PPVELFVDWL

SEQ ID NO: 9356 - protein, 10 aa, Homo Sapiens
GRALLFQGVV

SEQ ID NO: 9357 - protein, 10 aa, Homo Sapiens
LVNMLVLGKH

SEQ ID NO: 9358 - protein, 10 aa, Homo Sapiens
GPIINGCCCL

SEQ ID NO: 9359 - protein, 10 aa, Homo Sapiens
VRSLLEPLGL

SEQ ID NO: 9360 - protein, 10 aa, Homo Sapiens
TPYHMLHGEV

SEQ ID NO: 9361 - protein, 10 aa, Homo Sapiens
RIVRVSLEHP

SEQ ID NO: 9362 - protein, 10 aa, Homo Sapiens
GTPGVDIYIS

SEQ ID NO: 9363 - protein, 10 aa, Homo Sapiens
DATLEIIVVM

SEQ ID NO: 9364 - protein, 10 aa, Homo Sapiens
NDLNDSHVQI

SEQ ID NO: 9365 - protein, 10 aa, Homo Sapiens
HEPLPLAYAV

SEQ ID NO: 9366 - protein, 10 aa, Homo Sapiens
VWGPSGYGGI

SEQ ID NO: 9367 - protein, 10 aa, Homo Sapiens
LLVNCDRDDP

SEQ ID NO: 9368 - protein, 10 aa, Homo Sapiens
MVLRTQGPAA

SEQ ID NO: 9369 - protein, 10 aa, Homo Sapiens
VLHTSSYDAK

SEQ ID NO: 9370 - protein, 10 aa, Homo Sapiens
HICGPEDVCE

SEQ ID NO: 9371 - protein, 10 aa, Homo Sapiens
HVLGQDKVSY

SEQ ID NO: 9372 - protein, 10 aa, Homo Sapiens
RLHGDEERFF

SEQ ID NO: 9373 - protein, 10 aa, Homo Sapiens
GFTGLISFHV

SEQ ID NO: 9374 - protein, 10 aa, Homo Sapiens
ASPIFTDTVV

SEQ ID NO: 9375 - protein, 10 aa, Homo Sapiens
PIFTDTVVFR

SEQ ID NO: 9376 - protein, 10 aa, Homo Sapiens
TVVFRVAPWI

SEQ ID NO: 9377 - protein, 10 aa, Homo Sapiens
VAPWIMTPST

SEQ ID NO: 9378 - protein, 10 aa, Homo Sapiens
ARKAGCKLTI

SEQ ID NO: 9379 - protein, 10 aa, Homo Sapiens
DRWIQDEMEL

SEQ ID NO: 9380 - protein, 10 aa, Homo Sapiens
GYVQAPHKTL

SEQ ID NO: 9381 - protein, 10 aa, Homo Sapiens
KEYPLGRILI

SEQ ID NO: 9382 - protein, 10 aa, Homo Sapiens
PLGRILIGGN

SEQ ID NO: 9383 - protein, 10 aa, Homo Sapiens
LGRILIGGNL

SEQ ID NO: 9384 - protein, 10 aa, Homo Sapiens
SSGRRVTQVV

SEQ ID NO: 9385 - protein, 10 aa, Homo Sapiens
VRDFLHAQKV

SEQ ID NO: 9386 - protein, 10 aa, Homo Sapiens
KDLINYNKFV

SEQ ID NO: 9387 - protein, 10 aa, Homo Sapiens
LINYNKFVQS

SEQ ID NO: 9388 - protein, 10 aa, Homo Sapiens
QSCIDWNREV

SEQ ID NO: 9389 - protein, 10 aa, Homo Sapiens
REVLKRELGL

SEQ ID NO: 9390 - protein, 10 aa, Homo Sapiens
VLKRELGLAE

SEQ ID NO: 9391 - protein, 10 aa, Homo Sapiens
LKRELGLAEC

SEQ ID NO: 9392 - protein, 10 aa, Homo Sapiens
RELGLAECDI

SEQ ID NO: 9393 - protein, 10 aa, Homo Sapiens
ECDIIDIPQL

SEQ ID NO: 9394 - protein, 10 aa, Homo Sapiens
FFPDLVNMLV

SEQ ID NO: 9395 - protein, 10 aa, Homo Sapiens
FPDLVNMLVL

SEQ ID NO: 9396 - protein, 10 aa, Homo Sapiens
NGCCCLEEKV

SEQ ID NO: 9397 - protein, 10 aa, Homo Sapiens
IDDFTPYHML

SEQ ID NO: 9398 - protein, 10 aa, Homo Sapiens
IVRVSLEHPT

SEQ ID NO: 9399 - protein, 10 aa, Homo Sapiens
VCVAGVETLV

SEQ ID NO: 9400 - protein, 10 aa, Homo Sapiens
TLVDIYGSVP

SEQ ID NO: 9401 - protein, 10 aa, Homo Sapiens
MFEVYGTPGV

SEQ ID NO: 9402 - protein, 10 aa, Homo Sapiens
YGTPGVDIYI

SEQ ID NO: 9403 - protein, 10 aa, Homo Sapiens
CEGRQDRNFV

SEQ ID NO: 9404 - protein, 10 aa, Homo Sapiens
RNFVDKRQWV

SEQ ID NO: 9405 - protein, 10 aa, Homo Sapiens
PSGYGGILLV

SEQ ID NO: 9406 - protein, 10 aa, Homo Sapiens
GILLVNCDRD

SEQ ID NO: 9407 - protein, 10 aa, Homo Sapiens
CDRDDPSCDV

SEQ ID NO: 9408 - protein, 10 aa, Homo Sapiens
KLVLHTSSYD

SEQ ID NO: 9409 - protein, 10 aa, Homo Sapiens
VFHICGPEDV

SEQ ID NO: 9410 - protein, 10 aa, Homo Sapiens
FVEGLSFPDA

SEQ ID NO: 9411 - protein, 10 aa, Homo Sapiens
TICPQAENRN

SEQ ID NO: 9412 - protein, 10 aa, Homo Sapiens
QAENRNDRWI

SEQ ID NO: 9413 - protein, 10 aa, Homo Sapiens
WIQDEMELGY

SEQ ID NO: 9414 - protein, 10 aa, Homo Sapiens
KTLPVVFDSP

SEQ ID NO: 9415 - protein, 10 aa, Homo Sapiens
LQDFPYKRIL

SEQ ID NO: 9416 - protein, 10 aa, Homo Sapiens
VSGLDSFGNL

SEQ ID NO: 9417 - protein, 10 aa, Homo Sapiens
YPLGRILIGG

SEQ ID NO: 9418 - protein, 10 aa, Homo Sapiens
RILIGGNLPG

SEQ ID NO: 9419 - protein, 10 aa, Homo Sapiens
FLSFVPAPDG

SEQ ID NO: 9420 - protein, 10 aa, Homo Sapiens
RMLLASPGAC

SEQ ID NO: 9421 - protein, 10 aa, Homo Sapiens
KLFQEKQKCG

SEQ ID NO: 9422 - protein, 10 aa, Homo Sapiens
KQKCGHGRAL

SEQ ID NO: 9423 - protein, 10 aa, Homo Sapiens
HGRALLFQGV

SEQ ID NO: 9424 - protein, 10 aa, Homo Sapiens
FQGVVDDEQV

SEQ ID NO: 9425 - protein, 10 aa, Homo Sapiens
INQVLSNKDL

SEQ ID NO: 9426 - protein, 10 aa, Homo Sapiens
DLINYNKFVQ

SEQ ID NO: 9427 - protein, 10 aa, Homo Sapiens
EVLKRELGLA

SEQ ID NO: 9428 - protein, 10 aa, Homo Sapiens
DIIDIPQLFK

SEQ ID NO: 9429 - protein, 10 aa, Homo Sapiens
VNMLVLGKHL

SEQ ID NO: 9430 - protein, 10 aa, Homo Sapiens
NMLVLGKHLG

SEQ ID NO: 9431 - protein, 10 aa, Homo Sapiens
VLGKHLGIPK

SEQ ID NO: 9432 - protein, 10 aa, Homo Sapiens
HLGIPKPFGP

SEQ ID NO: 9433 - protein, 10 aa, Homo Sapiens
EKVRSLLEPL

SEQ ID NO: 9434 - protein, 10 aa, Homo Sapiens
RVSLEHPTSA

SEQ ID NO: 9435 - protein, 10 aa, Homo Sapiens
GVDIYISPNM

SEQ ID NO: 9436 - protein, 10 aa, Homo Sapiens
DIYISPNMER

SEQ ID NO: 9437 - protein, 10 aa, Homo Sapiens
RWRFDATLEI

SEQ ID NO: 9438 - protein, 10 aa, Homo Sapiens
RFDATLEIIV

SEQ ID NO: 9439 - protein, 10 aa, Homo Sapiens
VMNSPSNDLN

SEQ ID NO: 9440 - protein, 10 aa, Homo Sapiens
QISYHSSHEP

SEQ ID NO: 9441 - protein, 10 aa, Homo Sapiens
LAYAVLYLTC

SEQ ID NO: 9442 - protein, 10 aa, Homo Sapiens
ISLDCDLNCE

SEQ ID NO: 9443 - protein, 10 aa, Homo Sapiens
DLNCEGRQDR

SEQ ID NO: 9444 - protein, 10 aa, Homo Sapiens
WGPSGYGGIL

SEQ ID NO: 9445 - protein, 10 aa, Homo Sapiens
SGYGGILLVN

SEQ ID NO: 9446 - protein, 10 aa, Homo Sapiens
FDDHKLVLHT

SEQ ID NO: 9447 - protein, 10 aa, Homo Sapiens
FTGLISFHVT

SEQ ID NO: 9448 - protein, 10 aa, Homo Sapiens
LISFHVTLLD

SEQ ID NO: 9449 - protein, 10 aa, Homo Sapiens
VTLLDDSNED

SEQ ID NO: 9450 - protein, 10 aa, Homo Sapiens
SNEDFSASPI

SEQ ID NO: 9451 - protein, 10 aa, Homo Sapiens
VVFRVAPWIM

SEQ ID NO: 9452 - protein, 10 aa, Homo Sapiens
WIMTPSTLPP

SEQ ID NO: 9453 - protein, 10 aa, Homo Sapiens
CRVRNNTCFV

SEQ ID NO: 9454 - protein, 10 aa, Homo Sapiens
AVAELARKAG

SEQ ID NO: 9455 - protein, 10 aa, Homo Sapiens
LGYVQAPHKT

SEQ ID NO: 9456 - protein, 10 aa, Homo Sapiens
TLPVVFDSPR

SEQ ID NO: 9457 - protein, 10 aa, Homo Sapiens
QVVRDFLHAQ

SEQ ID NO: 9458 - protein, 10 aa, Homo Sapiens
KGFRMLLASP

SEQ ID NO: 9459 - protein, 10 aa, Homo Sapiens
VKTISINQVL

SEQ ID NO: 9460 - protein, 10 aa, Homo Sapiens
CIDWNREVLK

SEQ ID NO: 9461 - protein, 10 aa, Homo Sapiens
IDWNREVLKR

SEQ ID NO: 9462 - protein, 10 aa, Homo Sapiens
FKTERKKATA

SEQ ID NO: 9463 - protein, 10 aa, Homo Sapiens
KPFGPIINGC

SEQ ID NO: 9464 - protein, 10 aa, Homo Sapiens
FTPYHMLHGE

SEQ ID NO: 9465 - protein, 10 aa, Homo Sapiens
CVAGVETLVD

SEQ ID NO: 9466 - protein, 10 aa, Homo Sapiens
VDIYGSVPEG

SEQ ID NO: 9467 - protein, 10 aa, Homo Sapiens
PSNDLNDSHV

SEQ ID NO: 9468 - protein, 10 aa, Homo Sapiens
HSSHEPLPLA

SEQ ID NO: 9469 - protein, 10 aa, Homo Sapiens
PLPLAYAVLY

SEQ ID NO: 9470 - protein, 10 aa, Homo Sapiens
WVWGPSGYGG

SEQ ID NO: 9471 - protein, 10 aa, Homo Sapiens
GYGGILLVNC

SEQ ID NO: 9472 - protein, 10 aa, Homo Sapiens
VHCLQDLEDM

SEQ ID NO: 9473 - protein, 10 aa, Homo Sapiens
LFDDHKLVLH

SEQ ID NO: 9474 - protein, 10 aa, Homo Sapiens
RAQVFHICGP

SEQ ID NO: 9475 - protein, 10 aa, Homo Sapiens
FPDAGFTGLI

SEQ ID NO: 9476 - protein, 10 aa, Homo Sapiens
FTDTVVFRVA

SEQ ID NO: 9477 - protein, 10 aa, Homo Sapiens
DTVVFRVAPW

SEQ ID NO: 9478 - protein, 10 aa, Homo Sapiens
YVCRVRNNTC

SEQ ID NO: 9479 - protein, 10 aa, Homo Sapiens
VDAVAELARK

SEQ ID NO: 9480 - protein, 10 aa, Homo Sapiens
DAVAELARKA

SEQ ID NO: 9481 - protein, 10 aa, Homo Sapiens
LARKAGCKLT

SEQ ID NO: 9482 - protein, 10 aa, Homo Sapiens
EMELGYVQAP

SEQ ID NO: 9483 - protein, 10 aa, Homo Sapiens
VVFDSPRNGE

SEQ ID NO: 9484 - protein, 10 aa, Homo Sapiens
SVSGLDSFGN

SEQ ID NO: 9485 - protein, 10 aa, Homo Sapiens
LEVSPPVVAN

SEQ ID NO: 9486 - protein, 10 aa, Homo Sapiens
EVSPPVVANG

SEQ ID NO: 9487 - protein, 10 aa, Homo Sapiens
VANGKEYPLG

SEQ ID NO: 9488 - protein, 10 aa, Homo Sapiens
GKEYPLGRIL

SEQ ID NO: 9489 - protein, 10 aa, Homo Sapiens
KTISINQVLS

SEQ ID NO: 9490 - protein, 10 aa, Homo Sapiens
INYNKFVQSC

SEQ ID NO: 9491 - protein, 10 aa, Homo Sapiens
NYNKFVQSCI

SEQ ID NO: 9492 - protein, 10 aa, Homo Sapiens
LAECDIIDIP

SEQ ID NO: 9493 - protein, 10 aa, Homo Sapiens
DIPQLFKTER

SEQ ID NO: 9494 - protein, 10 aa, Homo Sapiens
EPLGLHCTFI

SEQ ID NO: 9495 - protein, 10 aa, Homo Sapiens
HGEVHCGTNV

SEQ ID NO: 9496 - protein, 10 aa, Homo Sapiens
AGVETLVDIY

SEQ ID NO: 9497 - protein, 10 aa, Homo Sapiens
LVDIYGSVPE

SEQ ID NO: 9498 - protein, 10 aa, Homo Sapiens
YGSVPEGTEM

SEQ ID NO: 9499 - protein, 10 aa, Homo Sapiens
SVPEGTEMFE

SEQ ID NO: 9500 - protein, 10 aa, Homo Sapiens
EMFEVYGTPG

SEQ ID NO: 9501 - protein, 10 aa, Homo Sapiens
NMERGRERAD

SEQ ID NO: 9502 - protein, 10 aa, Homo Sapiens
MERGRERADT

SEQ ID NO: 9503 - protein, 10 aa, Homo Sapiens
DTRRWRFDAT

SEQ ID NO: 9504 - protein, 10 aa, Homo Sapiens
DISLDCDLNC

SEQ ID NO: 9505 - protein, 10 aa, Homo Sapiens
SVMVLRTQGP

SEQ ID NO: 9506 - protein, 10 aa, Homo Sapiens
QVFHICGPED

SEQ ID NO: 9507 - protein, 10 aa, Homo Sapiens
DAGFTGLISF

SEQ ID NO: 9508 - protein, 10 aa, Homo Sapiens
ISFHVTLLDD

SEQ ID NO: 9509 - protein, 10 aa, Homo Sapiens
LDDSNEDFSA

SEQ ID NO: 9510 - protein, 10 aa, Homo Sapiens
RVAPWIMTPS

SEQ ID NO: 9511 - protein, 10 aa, Homo Sapiens
VRNNTCFVDA

SEQ ID NO: 9512 - protein, 10 aa, Homo Sapiens
RKAGCKLTIC

SEQ ID NO: 9513 - protein, 10 aa, Homo Sapiens
LTICPQAENR

SEQ ID NO: 9514 - protein, 10 aa, Homo Sapiens
DEMELGYVQA

SEQ ID NO: 9515 - protein, 10 aa, Homo Sapiens
VVRDFLHAQK

SEQ ID NO: 9516 - protein, 10 aa, Homo Sapiens
FRMLLASPGA

SEQ ID NO: 9517 - protein, 10 aa, Homo Sapiens
RALLFQGVVD

SEQ ID NO: 9518 - protein, 10 aa, Homo Sapiens
DDEQVKTISI

SEQ ID NO: 9519 - protein, 10 aa, Homo Sapiens
ISINQVLSNK

SEQ ID NO: 9520 - protein, 10 aa, Homo Sapiens
NQVLSNKDLI

SEQ ID NO: 9521 - protein, 10 aa, Homo Sapiens
LSNKDLINYN

SEQ ID NO: 9522 - protein, 10 aa, Homo Sapiens
ATAFFPDLVN

SEQ ID NO: 9523 - protein, 10 aa, Homo Sapiens
LGKHLGIPKP

SEQ ID NO: 9524 - protein, 10 aa, Homo Sapiens
INGCCCLEEK

SEQ ID NO: 9525 - protein, 10 aa, Homo Sapiens
LEIIVVMNSP

SEQ ID NO: 9526 - protein, 10 aa, Homo Sapiens
EIIVVMNSPS

SEQ ID NO: 9527 - protein, 10 aa, Homo Sapiens
LTCVDISLDC

SEQ ID NO: 9528 - protein, 10 aa, Homo Sapiens
FVDKRQWVWG

SEQ ID NO: 9529 - protein, 10 aa, Homo Sapiens
YGGILLVNCD

SEQ ID NO: 9530 - protein, 10 aa, Homo Sapiens
LVNCDRDDPS

SEQ ID NO: 9531 - protein, 10 aa, Homo Sapiens
HVHCLQDLED

SEQ ID NO: 9532 - protein, 10 aa, Homo Sapiens
EDMSVMVLRT

SEQ ID NO: 9533 - protein, 10 aa, Homo Sapiens
RTQGPAALFD

SEQ ID NO: 9534 - protein, 10 aa, Homo Sapiens
HTSSYDAKRA

SEQ ID NO: 9535 - protein, 10 aa, Homo Sapiens
EDVCEAYRHV

SEQ ID NO: 9536 - protein, 10 aa, Homo Sapiens
CEAYRHVLGQ

SEQ ID NO: 9537 - protein, 10 aa, Homo Sapiens
SYEVPRLHGD

SEQ ID NO: 9538 - protein, 10 aa, Homo Sapiens
LSFPDAGFTG

SEQ ID NO: 9539 - protein, 10 aa, Homo Sapiens
AGFTGLISFH

SEQ ID NO: 9540 - protein, 10 aa, Homo Sapiens
FSASPIFTDT

SEQ ID NO: 9541 - protein, 10 aa, Homo Sapiens
FRVAPWIMTP

SEQ ID NO: 9542 - protein, 10 aa, Homo Sapiens
FVDAVAELAR

SEQ ID NO: 9543 - protein, 10 aa, Homo Sapiens
VAELARKAGC

SEQ ID NO: 9544 - protein, 10 aa, Homo Sapiens
ELGYVQAPHK

SEQ ID NO: 9545 - protein, 10 aa, Homo Sapiens
LGPDFGYVTR

SEQ ID NO: 9546 - protein, 10 aa, Homo Sapiens
GRRVTQVVRD

SEQ ID NO: 9547 - protein, 10 aa, Homo Sapiens
VQPPVELFVD

SEQ ID NO: 9548 - protein, 10 aa, Homo Sapiens
PDGKGFRMLL

SEQ ID NO: 9549 - protein, 10 aa, Homo Sapiens
CGHGRALLFQ

SEQ ID NO: 9550 - protein, 10 aa, Homo Sapiens
QVLSNKDLIN

SEQ ID NO: 9551 - protein, 10 aa, Homo Sapiens
IDIPQLFKTE

SEQ ID NO: 9552 - protein, 10 aa, Homo Sapiens
PIINGCCCLE

SEQ ID NO: 9553 - protein, 10 aa, Homo Sapiens
PLGLHCTFID

SEQ ID NO: 9554 - protein, 10 aa, Homo Sapiens
VHCGTNVCRK

SEQ ID NO: 9555 - protein, 10 aa, Homo Sapiens
GTNVCRKPFS

SEQ ID NO: 9556 - protein, 10 aa, Homo Sapiens
PFSFKWWNMV

SEQ ID NO: 9557 - protein, 10 aa, Homo Sapiens
MSLQRIVRVS

SEQ ID NO: 9558 - protein, 10 aa, Homo Sapiens
LQRIVRVSLE

SEQ ID NO: 9559 - protein, 10 aa, Homo Sapiens
VETLVDIYGS

SEQ ID NO: 9560 - protein, 10 aa, Homo Sapiens
IVVMNSPSND

SEQ ID NO: 9561 - protein, 10 aa, Homo Sapiens
HVQISYHSSH

SEQ ID NO: 9562 - protein, 10 aa, Homo Sapiens
SSHEPLPLAY

SEQ ID NO: 9563 - protein, 10 aa, Homo Sapiens
YAVLYLTCVD

SEQ ID NO: 9564 - protein, 10 aa, Homo Sapiens
RQDRNFVDKR

SEQ ID NO: 9565 - protein, 10 aa, Homo Sapiens
LQDLEDMSVM

SEQ ID NO: 9566 - protein, 10 aa, Homo Sapiens
TQGPAALFDD

SEQ ID NO: 9567 - protein, 10 aa, Homo Sapiens
DDHKLVLHTS

SEQ ID NO: 9568 - protein, 10 aa, Homo Sapiens
YDAKRAQVFH

SEQ ID NO: 9569 - protein, 10 aa, Homo Sapiens
EAYRHVLGQD

SEQ ID NO: 9570 - protein, 10 aa, Homo Sapiens
GDEERFFVEG

SEQ ID NO: 9571 - protein, 10 aa, Homo Sapiens
SFHVTLLDDS

SEQ ID NO: 9572 - protein, 10 aa, Homo Sapiens
DSNEDFSASP

SEQ ID NO: 9573 - protein, 10 aa, Homo Sapiens
PLEVYVCRVR

SEQ ID NO: 9574 - protein, 10 aa, Homo Sapiens
EVYVCRVRNN

SEQ ID NO: 9575 - protein, 10 aa, Homo Sapiens
VYVCRVRNNT

SEQ ID NO: 9576 - protein, 10 aa, Homo Sapiens
NTCFVDAVAE

SEQ ID NO: 9577 - protein, 10 aa, Homo Sapiens
AGCKLTICPQ

SEQ ID NO: 9578 - protein, 10 aa, Homo Sapiens
NRNDRWIQDE

SEQ ID NO: 9579 - protein, 10 aa, Homo Sapiens
RNDRWIQDEM

SEQ ID NO: 9580 - protein, 10 aa, Homo Sapiens
MELGYVQAPH

SEQ ID NO: 9581 - protein, 10 aa, Homo Sapiens
YVQAPHKTLP

SEQ ID NO: 9582 - protein, 10 aa, Homo Sapiens
SPRNGELQDF

SEQ ID NO: 9583 - protein, 10 aa, Homo Sapiens
GELQDFPYKR

SEQ ID NO: 9584 - protein, 10 aa, Homo Sapiens
FPYKRILGPD

SEQ ID NO: 9585 - protein, 10 aa, Homo Sapiens
SGLDSFGNLE

SEQ ID NO: 9586 - protein, 10 aa, Homo Sapiens
DSFGNLEVSP

SEQ ID NO: 9587 - protein, 10 aa, Homo Sapiens
SFGNLEVSPP

SEQ ID NO: 9588 - protein, 10 aa, Homo Sapiens
LPGSSGRRVT

SEQ ID NO: 9589 - protein, 10 aa, Homo Sapiens
LFVDWLAVGH

SEQ ID NO: 9590 - protein, 10 aa, Homo Sapiens
AVGHVDEFLS

SEQ ID NO: 9591 - protein, 10 aa, Homo Sapiens
HVDEFLSFVP

SEQ ID NO: 9592 - protein, 10 aa, Homo Sapiens
DEFLSFVPAP

SEQ ID NO: 9593 - protein, 10 aa, Homo Sapiens
SFVPAPDGKG

SEQ ID NO: 9594 - protein, 10 aa, Homo Sapiens
PAPDGKGFRM

SEQ ID NO: 9595 - protein, 10 aa, Homo Sapiens
GKGFRMLLAS

SEQ ID NO: 9596 - protein, 10 aa, Homo Sapiens
GACFKLFQEK

SEQ ID NO: 9597 - protein, 10 aa, Homo Sapiens
LFQGVVDDEQ

SEQ ID NO: 9598 - protein, 10 aa, Homo Sapiens
KHLGIPKPFG

SEQ ID NO: 9599 - protein, 10 aa, Homo Sapiens
KVRSLLEPLG

SEQ ID NO: 9600 - protein, 10 aa, Homo Sapiens
RSLLEPLGLH

SEQ ID NO: 9601 - protein, 10 aa, Homo Sapiens
LHCTFIDDFT

SEQ ID NO: 9602 - protein, 10 aa, Homo Sapiens
LHGEVHCGTN

SEQ ID NO: 9603 - protein, 10 aa, Homo Sapiens
KPFSFKWWNM

SEQ ID NO: 9604 - protein, 10 aa, Homo Sapiens
QRIVRVSLEH

SEQ ID NO: 9605 - protein, 10 aa, Homo Sapiens
EHPTSAVCVA

SEQ ID NO: 9606 - protein, 10 aa, Homo Sapiens
VYGTPGVDIY

SEQ ID NO: 9607 - protein, 10 aa, Homo Sapiens
SPNMERGRER

SEQ ID NO: 9608 - protein, 10 aa, Homo Sapiens
ADTRRWRFDA

SEQ ID NO: 9609 - protein, 10 aa, Homo Sapiens
NSPSNDLNDS

SEQ ID NO: 9610 - protein, 10 aa, Homo Sapiens
SHVQISYHSS

SEQ ID NO: 9611 - protein, 10 aa, Homo Sapiens
TCVDISLDCD

SEQ ID NO: 9612 - protein, 10 aa, Homo Sapiens
VDKRQWVWGP

SEQ ID NO: 9613 - protein, 10 aa, Homo Sapiens
VNCDRDDPSC

SEQ ID NO: 9614 - protein, 10 aa, Homo Sapiens
LHTSSYDAKR

SEQ ID NO: 9615 - protein, 10 aa, Homo Sapiens
VSYEVPRLHG

SEQ ID NO: 9616 - protein, 10 aa, Homo Sapiens
RFFVEGLSFP

SEQ ID NO: 9617 - protein, 10 aa, Homo Sapiens
DFSASPIFTD

SEQ ID NO: 9618 - protein, 10 aa, Homo Sapiens
SPIFTDTVVF

SEQ ID NO: 9619 - protein, 10 aa, Homo Sapiens
VFRVAPWIMT

SEQ ID NO: 9620 - protein, 10 aa, Homo Sapiens
MTPSTLPPLE

SEQ ID NO: 9621 - protein, 10 aa, Homo Sapiens
NNTCFVDAVA

SEQ ID NO: 9622 - protein, 10 aa, Homo Sapiens
CFVDAVAELA

SEQ ID NO: 9623 - protein, 10 aa, Homo Sapiens
KAGCKLTICP

SEQ ID NO: 9624 - protein, 10 aa, Homo Sapiens
GCKLTICPQA

SEQ ID NO: 9625 - protein, 10 aa, Homo Sapiens
YVTREPRDRS

SEQ ID NO: 9626 - protein, 10 aa, Homo Sapiens
DRSVSGLDSF

SEQ ID NO: 9627 - protein, 10 aa, Homo Sapiens
LDSFGNLEVS

SEQ ID NO: 9628 - protein, 10 aa, Homo Sapiens
VSPPVVANGK

SEQ ID NO: 9629 - protein, 10 aa, Homo Sapiens
GNLPGSSGRR

SEQ ID NO: 9630 - protein, 10 aa, Homo Sapiens
VTQVVRDFLH

SEQ ID NO: 9631 - protein, 10 aa, Homo Sapiens
TQVVRDFLHA

SEQ ID NO: 9632 - protein, 10 aa, Homo Sapiens
HAQKVQPPVE

SEQ ID NO: 9633 - protein, 10 aa, Homo Sapiens
VDEFLSFVPA

SEQ ID NO: 9634 - protein, 10 aa, Homo Sapiens
FVPAPDGKGF

SEQ ID NO: 9635 - protein, 10 aa, Homo Sapiens
VPAPDGKGFR

SEQ ID NO: 9636 - protein, 10 aa, Homo Sapiens
DGKGFRMLLA

SEQ ID NO: 9637 - protein, 10 aa, Homo Sapiens
ACFKLFQEKQ

SEQ ID NO: 9638 - protein, 10 aa, Homo Sapiens
LFQEKQKCGH

SEQ ID NO: 9639 - protein, 10 aa, Homo Sapiens
GHGRALLFQG

SEQ ID NO: 9640 - protein, 10 aa, Homo Sapiens
KFVQSCIDWN

SEQ ID NO: 9641 - protein, 10 aa, Homo Sapiens
FVQSCIDWNR

SEQ ID NO: 9642 - protein, 10 aa, Homo Sapiens
LFKTERKKAT

SEQ ID NO: 9643 - protein, 10 aa, Homo Sapiens
KTERKKATAF

SEQ ID NO: 9644 - protein, 10 aa, Homo Sapiens
PDLVNMLVLG

SEQ ID NO: 9645 - protein, 10 aa, Homo Sapiens
CTFIDDFTPY

SEQ ID NO: 9646 - protein, 10 aa, Homo Sapiens
YHMLHGEVHC

SEQ ID NO: 9647 - protein, 10 aa, Homo Sapiens
VRVSLEHPTS

SEQ ID NO: 9648 - protein, 10 aa, Homo Sapiens
GVETLVDIYG

SEQ ID NO: 9649 - protein, 10 aa, Homo Sapiens
IYGSVPEGTE

SEQ ID NO: 9650 - protein, 10 aa, Homo Sapiens
IYISPNMERG

SEQ ID NO: 9651 - protein, 10 aa, Homo Sapiens
PNMERGRERA

SEQ ID NO: 9652 - protein, 10 aa, Homo Sapiens
RADTRRWRFD

SEQ ID NO: 9653 - protein, 10 aa, Homo Sapiens
SPSNDLNDSH

SEQ ID NO: 9654 - protein, 10 aa, Homo Sapiens
LNDSHVQISY

SEQ ID NO: 9655 - protein, 10 aa, Homo Sapiens
NDSHVQISYH

SEQ ID NO: 9656 - protein, 10 aa, Homo Sapiens
LDCDLNCEGR

SEQ ID NO: 9657 - protein, 10 aa, Homo Sapiens
LNCEGRQDRN

SEQ ID NO: 9658 - protein, 10 aa, Homo Sapiens
GRQDRNFVDK

SEQ ID NO: 9659 - protein, 10 aa, Homo Sapiens
KRQWVWGPSG

SEQ ID NO: 9660 - protein, 10 aa, Homo Sapiens
RDDPSCDVQD

SEQ ID NO: 9661 - protein, 10 aa, Homo Sapiens
LEDMSVMVLR

SEQ ID NO: 9662 - protein, 10 aa, Homo Sapiens
HKLVLHTSSY

SEQ ID NO: 9663 - protein, 10 aa, Homo Sapiens
KVSYEVPRLH

SEQ ID NO: 9664 - protein, 10 aa, Homo Sapiens
YEVPRLHGDE

SEQ ID NO: 9665 - protein, 10 aa, Homo Sapiens
LPPLEVYVCR

SEQ ID NO: 9666 - protein, 10 aa, Homo Sapiens
RVRNNTCFVD

SEQ ID NO: 9667 - protein, 10 aa, Homo Sapiens
AELARKAGCK

SEQ ID NO: 9668 - protein, 10 aa, Homo Sapiens
APHKTLPVVF

SEQ ID NO: 9669 - protein, 10 aa, Homo Sapiens
DFPYKRILGP

SEQ ID NO: 9670 - protein, 10 aa, Homo Sapiens
KRILGPDFGY

SEQ ID NO: 9671 - protein, 10 aa, Homo Sapiens
GPDFGYVTRE

SEQ ID NO: 9672 - protein, 10 aa, Homo Sapiens
REPRDRSVSG

SEQ ID NO: 9673 - protein, 10 aa, Homo Sapiens
SPPVVANGKE

SEQ ID NO: 9674 - protein, 10 aa, Homo Sapiens
ANGKEYPLGR

SEQ ID NO: 9675 - protein, 10 aa, Homo Sapiens
GRILIGGNLP

SEQ ID NO: 9676 - protein, 10 aa, Homo Sapiens
IGGNLPGSSG

SEQ ID NO: 9677 - protein, 10 aa, Homo Sapiens
SGRRVTQVVR

SEQ ID NO: 9678 - protein, 10 aa, Homo Sapiens
RRVTQVVRDF

SEQ ID NO: 9679 - protein, 10 aa, Homo Sapiens
QKVQPPVELF

SEQ ID NO: 9680 - protein, 10 aa, Homo Sapiens
PVELFVDWLA

SEQ ID NO: 9681 - protein, 10 aa, Homo Sapiens
VGHVDEFLSF

SEQ ID NO: 9682 - protein, 10 aa, Homo Sapiens
LSFVPAPDGK

SEQ ID NO: 9683 - protein, 10 aa, Homo Sapiens
FKLFQEKQKC

SEQ ID NO: 9684 - protein, 10 aa, Homo Sapiens
LGLAECDIID

SEQ ID NO: 9685 - protein, 10 aa, Homo Sapiens
LEPLGLHCTF

SEQ ID NO: 9686 - protein, 10 aa, Homo Sapiens
LGLHCTFIDD

SEQ ID NO: 9687 - protein, 10 aa, Homo Sapiens
TFIDDFTPYH

SEQ ID NO: 9688 - protein, 10 aa, Homo Sapiens
NVCRKPFSFK

SEQ ID NO: 9689 - protein, 10 aa, Homo Sapiens
GSVPEGTEMF

SEQ ID NO: 9690 - protein, 10 aa, Homo Sapiens
VDIYISPNME

SEQ ID NO: 9691 - protein, 10 aa, Homo Sapiens
MNSPSNDLND

SEQ ID NO: 9692 - protein, 10 aa, Homo Sapiens
SNDLNDSHVQ

SEQ ID NO: 9693 - protein, 10 aa, Homo Sapiens
VQISYHSSHE

SEQ ID NO: 9694 - protein, 10 aa, Homo Sapiens
SYHSSHEPLP

SEQ ID NO: 9695 - protein, 10 aa, Homo Sapiens
VDISLDCDLN

SEQ ID NO: 9696 - protein, 10 aa, Homo Sapiens
GGILLVNCDR

SEQ ID NO: 9697 - protein, 10 aa, Homo Sapiens
DDPSCDVQDN

SEQ ID NO: 9698 - protein, 10 aa, Homo Sapiens
QDNCDQHVHC

SEQ ID NO: 9699 - protein, 10 aa, Homo Sapiens
LRTQGPAALF

SEQ ID NO: 9700 - protein, 10 aa, Homo Sapiens
GPAALFDDHK

SEQ ID NO: 9701 - protein, 10 aa, Homo Sapiens
AKRAQVFHIC

SEQ ID NO: 9702 - protein, 10 aa, Homo Sapiens
KRAQVFHICG

SEQ ID NO: 9703 - protein, 10 aa, Homo Sapiens
FHICGPEDVC

SEQ ID NO: 9704 - protein, 10 aa, Homo Sapiens
CGPEDVCEAY

SEQ ID NO: 9705 - protein, 10 aa, Homo Sapiens
GPEDVCEAYR

SEQ ID NO: 9706 - protein, 10 aa, Homo Sapiens
EVPRLHGDEE

SEQ ID NO: 9707 - protein, 10 aa, Homo Sapiens
VPRLHGDEER

SEQ ID NO: 9708 - protein, 10 aa, Homo Sapiens
FFVEGLSFPD

SEQ ID NO: 9709 - protein, 10 aa, Homo Sapiens
FHVTLLDDSN

SEQ ID NO: 9710 - protein, 10 aa, Homo Sapiens
HVTLLDDSNE

SEQ ID NO: 9711 - protein, 10 aa, Homo Sapiens
LEVYVCRVRN

SEQ ID NO: 9712 - protein, 10 aa, Homo Sapiens
CKLTICPQAE

SEQ ID NO: 9713 - protein, 10 aa, Homo Sapiens
AENRNDRWIQ

SEQ ID NO: 9714 - protein, 10 aa, Homo Sapiens
HKTLPVVFDS

SEQ ID NO: 9715 - protein, 10 aa, Homo Sapiens
LPVVFDSPRN

SEQ ID NO: 9716 - protein, 10 aa, Homo Sapiens
FDSPRNGELQ

SEQ ID NO: 9717 - protein, 10 aa, Homo Sapiens
QDFPYKRILG

SEQ ID NO: 9718 - protein, 10 aa, Homo Sapiens
FGYVTREPRD

SEQ ID NO: 9719 - protein, 10 aa, Homo Sapiens
GGNLPGSSGR

SEQ ID NO: 9720 - protein, 10 aa, Homo Sapiens
DFLHAQKVQP

SEQ ID NO: 9721 - protein, 10 aa, Homo Sapiens
VDWLAVGHVD

SEQ ID NO: 9722 - protein, 10 aa, Homo Sapiens
DWLAVGHVDE

SEQ ID NO: 9723 - protein, 10 aa, Homo Sapiens
ASPGACFKLF

SEQ ID NO: 9724 - protein, 10 aa, Homo Sapiens
SPGACFKLFQ

SEQ ID NO: 9725 - protein, 10 aa, Homo Sapiens
PGACFKLFQE

SEQ ID NO: 9726 - protein, 10 aa, Homo Sapiens
VDDEQVKTIS

SEQ ID NO: 9727 - protein, 10 aa, Homo Sapiens
DEQVKTISIN

SEQ ID NO: 9728 - protein, 10 aa, Homo Sapiens
SNKDLINYNK

SEQ ID NO: 9729 - protein, 10 aa, Homo Sapiens
NKDLINYNKF

SEQ ID NO: 9730 - protein, 10 aa, Homo Sapiens
DWNREVLKRE

SEQ ID NO: 9731 - protein, 10 aa, Homo Sapiens
AECDIIDIPQ

SEQ ID NO: 9732 - protein, 10 aa, Homo Sapiens
IPKPFGPIIN

SEQ ID NO: 9733 - protein, 10 aa, Homo Sapiens
EEKVRSLLEP

SEQ ID NO: 9734 - protein, 10 aa, Homo Sapiens
EVHCGTNVCR

SEQ ID NO: 9735 - protein, 10 aa, Homo Sapiens
VCRKPFSFKW

SEQ ID NO: 9736 - protein, 10 aa, Homo Sapiens
HPTSAVCVAG

SEQ ID NO: 9737 - protein, 10 aa, Homo Sapiens
TSAVCVAGVE

SEQ ID NO: 9738 - protein, 10 aa, Homo Sapiens
TEMFEVYGTP

SEQ ID NO: 9739 - protein, 10 aa, Homo Sapiens
TPGVDIYISP

SEQ ID NO: 9740 - protein, 10 aa, Homo Sapiens
PGVDIYISPN

SEQ ID NO: 9741 - protein, 10 aa, Homo Sapiens
ISPNMERGRE

SEQ ID NO: 9742 - protein, 10 aa, Homo Sapiens
RGRERADTRR

SEQ ID NO: 9743 - protein, 10 aa, Homo Sapiens
CDLNCEGRQD

SEQ ID NO: 9744 - protein, 10 aa, Homo Sapiens
RQWVWGPSGY

SEQ ID NO: 9745 - protein, 10 aa, Homo Sapiens
SCDVQDNCDQ

SEQ ID NO: 9746 - protein, 10 aa, Homo Sapiens
VQDNCDQHVH

SEQ ID NO: 9747 - protein, 10 aa, Homo Sapiens
HCLQDLEDMS

SEQ ID NO: 9748 - protein, 10 aa, Homo Sapiens
SYDAKRAQVF

SEQ ID NO: 9749 - protein, 10 aa, Homo Sapiens
VCEAYRHVLG

SEQ ID NO: 9750 - protein, 10 aa, Homo Sapiens
AYRHVLGQDK

SEQ ID NO: 9751 - protein, 10 aa, Homo Sapiens
HGDEERFFVE

SEQ ID NO: 9752 - protein, 10 aa, Homo Sapiens
VEGLSFPDAG

SEQ ID NO: 9753 - protein, 10 aa, Homo Sapiens
EGLSFPDAGF

SEQ ID NO: 9754 - protein, 10 aa, Homo Sapiens
PDAGFTGLIS

SEQ ID NO: 9755 - protein, 10 aa, Homo Sapiens
EDFSASPIFT

SEQ ID NO: 9756 - protein, 10 aa, Homo Sapiens
TDTVVFRVAP

SEQ ID NO: 9757 - protein, 10 aa, Homo Sapiens
ICPQAENRND

SEQ ID NO: 9758 - protein, 10 aa, Homo Sapiens
RWIQDEMELG

SEQ ID NO: 9759 - protein, 10 aa, Homo Sapiens
PHKTLPVVFD

SEQ ID NO: 9760 - protein, 10 aa, Homo Sapiens
RNGELQDFPY

SEQ ID NO: 9761 - protein, 10 aa, Homo Sapiens
YKRILGPDFG

SEQ ID NO: 9762 - protein, 10 aa, Homo Sapiens
PDFGYVTREP

SEQ ID NO: 9763 - protein, 10 aa, Homo Sapiens
EYPLGRILIG

SEQ ID NO: 9764 - protein, 10 aa, Homo Sapiens
QPPVELFVDW

SEQ ID NO: 9765 - protein, 10 aa, Homo Sapiens
KCGHGRALLF

SEQ ID NO: 9766 - protein, 10 aa, Homo Sapiens
VQSCIDWNRE

SEQ ID NO: 9767 - protein, 10 aa, Homo Sapiens
CDIIDIPQLF

SEQ ID NO: 9768 - protein, 10 aa, Homo Sapiens
IPQLFKTERK

SEQ ID NO: 9769 - protein, 10 aa, Homo Sapiens
TERKKATAFF

SEQ ID NO: 9770 - protein, 10 aa, Homo Sapiens
CCCLEEKVRS

SEQ ID NO: 9771 - protein, 10 aa, Homo Sapiens
LEEKVRSLLE

SEQ ID NO: 9772 - protein, 10 aa, Homo Sapiens
GEVHCGTNVC

SEQ ID NO: 9773 - protein, 10 aa, Homo Sapiens
HCGTNVCRKP

SEQ ID NO: 9774 - protein, 10 aa, Homo Sapiens
TNVCRKPFSF

SEQ ID NO: 9775 - protein, 10 aa, Homo Sapiens
FSFKWWNMVP

SEQ ID NO: 9776 - protein, 10 aa, Homo Sapiens
RRWRFDATLE

SEQ ID NO: 9777 - protein, 10 aa, Homo Sapiens
NCEGRQDRNF

SEQ ID NO: 9778 - protein, 10 aa, Homo Sapiens
NFVDKRQWVW

SEQ ID NO: 9779 - protein, 10 aa, Homo Sapiens
CDQHVHCLQD

SEQ ID NO: 9780 - protein, 10 aa, Homo Sapiens
AQVFHICGPE

SEQ ID NO: 9781 - protein, 10 aa, Homo Sapiens
GQDKVSYEVP

SEQ ID NO: 9782 - protein, 10 aa, Homo Sapiens
QDKVSYEVPR

SEQ ID NO: 9783 - protein, 10 aa, Homo Sapiens
VCRVRNNTCF

SEQ ID NO: 9784 - protein, 10 aa, Homo Sapiens
CPQAENRNDR

SEQ ID NO: 9785 - protein, 10 aa, Homo Sapiens
PQAENRNDRW

SEQ ID NO: 9786 - protein, 10 aa, Homo Sapiens
GYVTREPRDR

SEQ ID NO: 9787 - protein, 10 aa, Homo Sapiens
TREPRDRSVS

SEQ ID NO: 9788 - protein, 10 aa, Homo Sapiens
RDRSVSGLDS

SEQ ID NO: 9789 - protein, 10 aa, Homo Sapiens
PVVANGKEYP

SEQ ID NO: 9790 - protein, 10 aa, Homo Sapiens
PGSSGRRVTQ

SEQ ID NO: 9791 - protein, 10 aa, Homo Sapiens
EFLSFVPAPD

SEQ ID NO: 9792 - protein, 10 aa, Homo Sapiens
GFRMLLASPG

SEQ ID NO: 9793 - protein, 10 aa, Homo Sapiens
QEKQKCGHGR

SEQ ID NO: 9794 - protein, 10 aa, Homo Sapiens
EKQKCGHGRA

SEQ ID NO: 9795 - protein, 10 aa, Homo Sapiens
NKFVQSCIDW

SEQ ID NO: 9796 - protein, 10 aa, Homo Sapiens
FGPIINGCCC

SEQ ID NO: 9797 - protein, 10 aa, Homo Sapiens
DFTPYHMLHG

SEQ ID NO: 9798 - protein, 10 aa, Homo Sapiens
ERGRERADTR

SEQ ID NO: 9799 - protein, 10 aa, Homo Sapiens
DCDLNCEGRQ

SEQ ID NO: 9800 - protein, 10 aa, Homo Sapiens
QDRNFVDKRQ

SEQ ID NO: 9801 - protein, 10 aa, Homo Sapiens
DRNFVDKRQW

SEQ ID NO: 9802 - protein, 10 aa, Homo Sapiens
DKRQWVWGPS

SEQ ID NO: 9803 - protein, 10 aa, Homo Sapiens
DPSCDVQDNC

SEQ ID NO: 9804 - protein, 10 aa, Homo Sapiens
PSCDVQDNCD

SEQ ID NO: 9805 - protein, 10 aa, Homo Sapiens
RHVLGQDKVS

SEQ ID NO: 9806 - protein, 10 aa, Homo Sapiens
PRLHGDEERF

SEQ ID NO: 9807 - protein, 10 aa, Homo Sapiens
PWIMTPSTLP

SEQ ID NO: 9808 - protein, 10 aa, Homo Sapiens
NREVLKRELG

SEQ ID NO: 9809 - protein, 10 aa, Homo Sapiens
RKKATAFFPD

SEQ ID NO: 9810 - protein, 10 aa, Homo Sapiens
PFGPIINGCC

SEQ ID NO: 9811 - protein, 10 aa, Homo Sapiens
RKPFSFKWWN

SEQ ID NO: 9812 - protein, 10 aa, Homo Sapiens
PEDVCEAYRH

SEQ ID NO: 9813 - protein, 10 aa, Homo Sapiens
DFGYVTREPR

SEQ ID NO: 9814 - protein, 10 aa, Homo Sapiens
PPVVANGKEY

SEQ ID NO: 9815 - protein, 10 aa, Homo Sapiens
CFKLFQEKQK

SEQ ID NO: 9816 - protein, 10 aa, Homo Sapiens
CGTNVCRKPF

SEQ ID NO: 9817 - protein, 10 aa, Homo Sapiens
PEGTEMFEVY

SEQ ID NO: 9818 - protein, 10 aa, Homo Sapiens
EGRQDRNFVD

SEQ ID NO: 9819 - protein, 10 aa, Homo Sapiens
ENRNDRWIQD

SEQ ID NO: 9820 - protein, 10 aa, Homo Sapiens
PYKRILGPDF

SEQ ID NO: 9821 - protein, 10 aa, Homo Sapiens
PRDRSVSGLD

SEQ ID NO: 9822 - protein, 10 aa, Homo Sapiens
EQVKTISINQ

SEQ ID NO: 9823 - protein, 10 aa, Homo Sapiens
PYHMLHGEVH

SEQ ID NO: 9824 - protein, 10 aa, Homo Sapiens
EERFFVEGLS

SEQ ID NO: 9825 - protein, 10 aa, Homo Sapiens
ERKKATAFFP

SEQ ID NO: 9826 - protein, 10 aa, Homo Sapiens
IMTPSTLAPL

SEQ ID NO: 9827 - protein, 10 aa, Homo Sapiens
STLAPLEVYV

SEQ ID NO: 9828 - protein, 10 aa, Homo Sapiens
APLEVYVCRV

SEQ ID NO: 9829 - protein, 10 aa, Homo Sapiens
TLAPLEVYVC

SEQ ID NO: 9830 - protein, 10 aa, Homo Sapiens
TPSTLAPLEV

SEQ ID NO: 9831 - protein, 10 aa, Homo Sapiens
WIMTPSTLAP

SEQ ID NO: 9832 - protein, 10 aa, Homo Sapiens
LAPLEVYVCR

SEQ ID NO: 9833 - protein, 10 aa, Homo Sapiens
MTPSTLAPLE

SEQ ID NO: 9834 - protein, 10 aa, Homo Sapiens
PWIMTPSTLA

SEQ ID NO: 9835 - protein, 10 aa, Homo Sapiens
PAALFDDHKL

SEQ ID NO: 9836 - protein, 10 aa, Homo Sapiens
AYAVLYLTCV

SEQ ID NO: 9837 - protein, 10 aa, Homo Sapiens
AVAELARKAG

SEQ ID NO: 9838 - protein, 10 aa, Homo Sapiens
ATAFFPDLVN

SEQ ID NO: 9839 - protein, 10 aa, Homo Sapiens
TSAVCVAGVE

SEQ ID NO: 9840 - protein, 10 aa, Homo Sapiens
CVAGVETLVD

SEQ ID NO: 9841 - protein, 10 aa, Homo Sapiens
ERADTRRWRF

SEQ ID NO: 9842 - protein, 10 aa, Homo Sapiens
FDATLEIIVV

SEQ ID NO: 9843 - protein, 10 aa, Homo Sapiens
PLAYAVLYLT

SEQ ID NO: 9844 - protein, 10 aa, Homo Sapiens
GPAALFDDHK

SEQ ID NO: 9845 - protein, 10 aa, Homo Sapiens
AALFDDHKLV

SEQ ID NO: 9846 - protein, 10 aa, Homo Sapiens
YDAKRAQVFH

SEQ ID NO: 9847 - protein, 10 aa, Homo Sapiens
KRAQVFHICG

SEQ ID NO: 9848 - protein, 10 aa, Homo Sapiens
CEAYRHVLGQ

SEQ ID NO: 9849 - protein, 10 aa, Homo Sapiens
PDAGFTGLIS

SEQ ID NO: 9850 - protein, 10 aa, Homo Sapiens
FSASPIFTDT

SEQ ID NO: 9851 - protein, 10 aa, Homo Sapiens
RVAPWIMTPS

SEQ ID NO: 9852 - protein, 10 aa, Homo Sapiens
VDAVAELARK

SEQ ID NO: 9853 - protein, 10 aa, Homo Sapiens
ELARKAGCKL

SEQ ID NO: 9854 - protein, 10 aa, Homo Sapiens
RKAGCKLTIC

SEQ ID NO: 9855 - protein, 10 aa, Homo Sapiens
PQAENRNDRW

SEQ ID NO: 9856 - protein, 10 aa, Homo Sapiens
VQAPHKTLPV

SEQ ID NO: 9857 - protein, 10 aa, Homo Sapiens
VVANGKEYPL

SEQ ID NO: 9858 - protein, 10 aa, Homo Sapiens
LHAQKVQPPV

SEQ ID NO: 9859 - protein, 10 aa, Homo Sapiens
WLAVGHVDEF

SEQ ID NO: 9860 - protein, 10 aa, Homo Sapiens
VPAPDGKGFR

SEQ ID NO: 9861 - protein, 10 aa, Homo Sapiens
LLASPGACFK

SEQ ID NO: 9862 - protein, 10 aa, Homo Sapiens
PGACFKLFQE

SEQ ID NO: 9863 - protein, 10 aa, Homo Sapiens
GRALLFQGVV

SEQ ID NO: 9864 - protein, 10 aa, Homo Sapiens
GLAECDIIDI

SEQ ID NO: 9865 - protein, 10 aa, Homo Sapiens
KKATAFFPDL

SEQ ID NO: 9866 - protein, 10 aa, Homo Sapiens
SAVCVAGVET

SEQ ID NO: 9867 - protein, 10 aa, Homo Sapiens
VAGVETLVDI

SEQ ID NO: 9868 - protein, 10 aa, Homo Sapiens
RADTRRWRFD

SEQ ID NO: 9869 - protein, 10 aa, Homo Sapiens
DATLEIIVVM

SEQ ID NO: 9870 - protein, 10 aa, Homo Sapiens
LAYAVLYLTC

SEQ ID NO: 9871 - protein, 10 aa, Homo Sapiens
YAVLYLTCVD

SEQ ID NO: 9872 - protein, 10 aa, Homo Sapiens
DAKRAQVFHI

SEQ ID NO: 9873 - protein, 10 aa, Homo Sapiens
RAQVFHICGP

SEQ ID NO: 9874 - protein, 10 aa, Homo Sapiens
EAYRHVLGQD

SEQ ID NO: 9875 - protein, 10 aa, Homo Sapiens
DAGFTGLISF

SEQ ID NO: 9876 - protein, 10 aa, Homo Sapiens
SASPIFTDTV

SEQ ID NO: 9877 - protein, 10 aa, Homo Sapiens
VAPWIMTPST

SEQ ID NO: 9878 - protein, 10 aa, Homo Sapiens
DAVAELARKA

SEQ ID NO: 9879 - protein, 10 aa, Homo Sapiens
VAELARKAGC

SEQ ID NO: 9880 - protein, 10 aa, Homo Sapiens
LARKAGCKLT

SEQ ID NO: 9881 - protein, 10 aa, Homo Sapiens
KAGCKLTICP

SEQ ID NO: 9882 - protein, 10 aa, Homo Sapiens
QAENRNDRWI

SEQ ID NO: 9883 - protein, 10 aa, Homo Sapiens
QAPHKTLPVV

SEQ ID NO: 9884 - protein, 10 aa, Homo Sapiens
VANGKEYPLG

SEQ ID NO: 9885 - protein, 10 aa, Homo Sapiens
HAQKVQPPVE

SEQ ID NO: 9886 - protein, 10 aa, Homo Sapiens
LAVGHVDEFL

SEQ ID NO: 9887 - protein, 10 aa, Homo Sapiens
PAPDGKGFRM

SEQ ID NO: 9888 - protein, 10 aa, Homo Sapiens
LASPGACFKL

SEQ ID NO: 9889 - protein, 10 aa, Homo Sapiens
GACFKLFQEK

SEQ ID NO: 9890 - protein, 10 aa, Homo Sapiens
RALLFQGVVD

SEQ ID NO: 9891 - protein, 10 aa, Homo Sapiens
LAECDIIDIP

SEQ ID NO: 9892 - protein, 10 aa, Homo Sapiens
KATAFFPDLV

SEQ ID NO: 9893 - protein, 10 aa, Homo Sapiens
TAFFPDLVNM

SEQ ID NO: 9894 - protein, 10 aa, Homo Sapiens
AVCVAGVETL

SEQ ID NO: 9895 - protein, 10 aa, Homo Sapiens
AGVETLVDIY

SEQ ID NO: 9896 - protein, 10 aa, Homo Sapiens
ADTRRWRFDA

SEQ ID NO: 9897 - protein, 10 aa, Homo Sapiens
ATLEIIVVMN

SEQ ID NO: 9898 - protein, 10 aa, Homo Sapiens
AVLYLTCVDI

SEQ ID NO: 9899 - protein, 10 aa, Homo Sapiens
ALFDDHKLVL

SEQ ID NO: 9900 - protein, 10 aa, Homo Sapiens
AKRAQVFHIC

SEQ ID NO: 9901 - protein, 10 aa, Homo Sapiens
AQVFHICGPE

SEQ ID NO: 9902 - protein, 10 aa, Homo Sapiens
AYRHVLGQDK

SEQ ID NO: 9903 - protein, 10 aa, Homo Sapiens
AGFTGLISFH

SEQ ID NO: 9904 - protein, 10 aa, Homo Sapiens
ASPIFTDTVV

SEQ ID NO: 9905 - protein, 10 aa, Homo Sapiens
APWIMTPSTL

SEQ ID NO: 9906 - protein, 10 aa, Homo Sapiens
AELARKAGCK

SEQ ID NO: 9907 - protein, 10 aa, Homo Sapiens
ARKAGCKLTI

SEQ ID NO: 9908 - protein, 10 aa, Homo Sapiens
AGCKLTICPQ

SEQ ID NO: 9909 - protein, 10 aa, Homo Sapiens
AENRNDRWIQ

SEQ ID NO: 9910 - protein, 10 aa, Homo Sapiens
APHKTLPVVF

SEQ ID NO: 9911 - protein, 10 aa, Homo Sapiens
ANGKEYPLGR

SEQ ID NO: 9912 - protein, 10 aa, Homo Sapiens
AQKVQPPVEL

SEQ ID NO: 9913 - protein, 10 aa, Homo Sapiens
AVGHVDEFLS

SEQ ID NO: 9914 - protein, 10 aa, Homo Sapiens
APDGKGFRML

SEQ ID NO: 9915 - protein, 10 aa, Homo Sapiens
ASPGACFKLF

SEQ ID NO: 9916 - protein, 10 aa, Homo Sapiens
ACFKLFQEKQ

SEQ ID NO: 9917 - protein, 10 aa, Homo Sapiens
ALLFQGVVDD

SEQ ID NO: 9918 - protein, 10 aa, Homo Sapiens
AECDIIDIPQ

SEQ ID NO: 9919 - protein, 10 aa, Homo Sapiens
AFFPDLVNML

SEQ ID NO: 9920 - protein, 10 aa, Homo Sapiens
TLAPLEVYVC

SEQ ID NO: 9921 - protein, 10 aa, Homo Sapiens
LAPLEVYVCR

SEQ ID NO: 9922 - protein, 10 aa, Homo Sapiens
APLEVYVCRV

SEQ ID NO: 9923 - protein, 10 aa, Homo Sapiens
MVLRTQGPAA

SEQ ID NO: 9924 - protein, 10 aa, Homo Sapiens
SHEPLPLAYA

SEQ ID NO: 9925 - protein, 10 aa, Homo Sapiens
NNTCFVDAVA

SEQ ID NO: 9926 - protein, 10 aa, Homo Sapiens
FKTERKKATA

SEQ ID NO: 9927 - protein, 10 aa, Homo Sapiens
VLRTQGPAAL

SEQ ID NO: 9928 - protein, 10 aa, Homo Sapiens
RVSLEHPTSA

SEQ ID NO: 9929 - protein, 10 aa, Homo Sapiens
EHPTSAVCVA

SEQ ID NO: 9930 - protein, 10 aa, Homo Sapiens
PNMERGRERA

SEQ ID NO: 9931 - protein, 10 aa, Homo Sapiens
ADTRRWRFDA

SEQ ID NO: 9932 - protein, 10 aa, Homo Sapiens
HSSHEPLPLA

SEQ ID NO: 9933 - protein, 10 aa, Homo Sapiens
VMVLRTQGPA

SEQ ID NO: 9934 - protein, 10 aa, Homo Sapiens
LVLHTSSYDA

SEQ ID NO: 9935 - protein, 10 aa, Homo Sapiens
HTSSYDAKRA

SEQ ID NO: 9936 - protein, 10 aa, Homo Sapiens
ICGPEDVCEA

SEQ ID NO: 9937 - protein, 10 aa, Homo Sapiens
FVEGLSFPDA

SEQ ID NO: 9938 - protein, 10 aa, Homo Sapiens
LDDSNEDFSA

SEQ ID NO: 9939 - protein, 10 aa, Homo Sapiens
FTDTVVFRVA

SEQ ID NO: 9940 - protein, 10 aa, Homo Sapiens
VRNNTCFVDA

SEQ ID NO: 9941 - protein, 10 aa, Homo Sapiens
CFVDAVAELA

SEQ ID NO: 9942 - protein, 10 aa, Homo Sapiens
DAVAELARKA

SEQ ID NO: 9943 - protein, 10 aa, Homo Sapiens
GCKLTICPQA

SEQ ID NO: 9944 - protein, 10 aa, Homo Sapiens
DEMELGYVQA

SEQ ID NO: 9945 - protein, 10 aa, Homo Sapiens
NLEVSPPVVA

SEQ ID NO: 9946 - protein, 10 aa, Homo Sapiens
TQVVRDFLHA

SEQ ID NO: 9947 - protein, 10 aa, Homo Sapiens
PVELFVDWLA

SEQ ID NO: 9948 - protein, 10 aa, Homo Sapiens
VDEFLSFVPA

SEQ ID NO: 9949 - protein, 10 aa, Homo Sapiens
DGKGFRMLLA

SEQ ID NO: 9950 - protein, 10 aa, Homo Sapiens
FRMLLASPGA

SEQ ID NO: 9951 - protein, 10 aa, Homo Sapiens
EKQKCGHGRA

SEQ ID NO: 9952 - protein, 10 aa, Homo Sapiens
EVLKRELGLA

SEQ ID NO: 9953 - protein, 10 aa, Homo Sapiens
QLFKTERKKA

SEQ ID NO: 9954 - protein, 10 aa, Homo Sapiens
VSLEHPTSAV

SEQ ID NO: 9955 - protein, 10 aa, Homo Sapiens
HPTSAVCVAG

SEQ ID NO: 9956 - protein, 10 aa, Homo Sapiens
NMERGRERAD

SEQ ID NO: 9957 - protein, 10 aa, Homo Sapiens
DTRRWRFDAT

SEQ ID NO: 9958 - protein, 10 aa, Homo Sapiens
SSHEPLPLAY

SEQ ID NO: 9959 - protein, 10 aa, Homo Sapiens
HEPLPLAYAV

SEQ ID NO: 9960 - protein, 10 aa, Homo Sapiens
VLHTSSYDAK

SEQ ID NO: 9961 - protein, 10 aa, Homo Sapiens
TSSYDAKRAQ

SEQ ID NO: 9962 - protein, 10 aa, Homo Sapiens
CGPEDVCEAY

SEQ ID NO: 9963 - protein, 10 aa, Homo Sapiens
VEGLSFPDAG

SEQ ID NO: 9964 - protein, 10 aa, Homo Sapiens
DDSNEDFSAS

SEQ ID NO: 9965 - protein, 10 aa, Homo Sapiens
TDTVVFRVAP

SEQ ID NO: 9966 - protein, 10 aa, Homo Sapiens
RNNTCFVDAV

SEQ ID NO: 9967 - protein, 10 aa, Homo Sapiens
NTCFVDAVAE

SEQ ID NO: 9968 - protein, 10 aa, Homo Sapiens
FVDAVAELAR

SEQ ID NO: 9969 - protein, 10 aa, Homo Sapiens
AVAELARKAG

SEQ ID NO: 9970 - protein, 10 aa, Homo Sapiens
CKLTICPQAE

SEQ ID NO: 9971 - protein, 10 aa, Homo Sapiens
EMELGYVQAP

SEQ ID NO: 9972 - protein, 10 aa, Homo Sapiens
LEVSPPVVAN

SEQ ID NO: 9973 - protein, 10 aa, Homo Sapiens
QVVRDFLHAQ

SEQ ID NO: 9974 - protein, 10 aa, Homo Sapiens
VELFVDWLAV

SEQ ID NO: 9975 - protein, 10 aa, Homo Sapiens
DEFLSFVPAP

SEQ ID NO: 9976 - protein, 10 aa, Homo Sapiens
GKGFRMLLAS

SEQ ID NO: 9977 - protein, 10 aa, Homo Sapiens
RMLLASPGAC

SEQ ID NO: 9978 - protein, 10 aa, Homo Sapiens
KQKCGHGRAL

SEQ ID NO: 9979 - protein, 10 aa, Homo Sapiens
VLKRELGLAE

SEQ ID NO: 9980 - protein, 10 aa, Homo Sapiens
LFKTERKKAT

SEQ ID NO: 9981 - protein, 10 aa, Homo Sapiens
KTERKKATAF

SEQ ID NO: 9982 - protein, 10 aa, Homo Sapiens
SLEHPTSAVC

SEQ ID NO: 9983 - protein, 10 aa, Homo Sapiens
PTSAVCVAGV

SEQ ID NO: 9984 - protein, 10 aa, Homo Sapiens
MERGRERADT

SEQ ID NO: 9985 - protein, 10 aa, Homo Sapiens
TRRWRFDATL

SEQ ID NO: 9986 - protein, 10 aa, Homo Sapiens
EPLPLAYAVL

SEQ ID NO: 9987 - protein, 10 aa, Homo Sapiens
LRTQGPAALF

SEQ ID NO: 9988 - protein, 10 aa, Homo Sapiens
LHTSSYDAKR

SEQ ID NO: 9989 - protein, 10 aa, Homo Sapiens
SSYDAKRAQV

SEQ ID NO: 9990 - protein, 10 aa, Homo Sapiens
GPEDVCEAYR

SEQ ID NO: 9991 - protein, 10 aa, Homo Sapiens
EGLSFPDAGF

SEQ ID NO: 9992 - protein, 10 aa, Homo Sapiens
DSNEDFSASP

SEQ ID NO: 9993 - protein, 10 aa, Homo Sapiens
DTVVFRVAPW

SEQ ID NO: 9994 - protein, 10 aa, Homo Sapiens
TCFVDAVAEL

SEQ ID NO: 9995 - protein, 10 aa, Homo Sapiens
VDAVAELARK

SEQ ID NO: 9996 - protein, 10 aa, Homo Sapiens
VAELARKAGC

SEQ ID NO: 9997 - protein, 10 aa, Homo Sapiens
KLTICPQAEN

SEQ ID NO: 9998 - protein, 10 aa, Homo Sapiens
MELGYVQAPH

SEQ ID NO: 9999 - protein, 10 aa, Homo Sapiens
EVSPPVVANG

SEQ ID NO: 10000 - protein, 10 aa, Homo Sapiens
VVRDFLHAQK

SEQ ID NO: 10001 - protein, 10 aa, Homo Sapiens
ELFVDWLAVG

SEQ ID NO: 10002 - protein, 10 aa, Homo Sapiens
EFLSFVPAPD

SEQ ID NO: 10003 - protein, 10 aa, Homo Sapiens
KGFRMLLASP

SEQ ID NO: 10004 - protein, 10 aa, Homo Sapiens
MLLASPGACF

SEQ ID NO: 10005 - protein, 10 aa, Homo Sapiens
QKCGHGRALL

SEQ ID NO: 10006 - protein, 10 aa, Homo Sapiens
LKRELGLAEC

SEQ ID NO: 10007 - protein, 10 aa, Homo Sapiens
TERKKATAFF

SEQ ID NO: 10008 - protein, 10 aa, Homo Sapiens
PWIMTPSTLA

SEQ ID NO: 10009 - protein, 10 aa, Homo Sapiens
WIMTPSTLAP

SEQ ID NO: 10010 - protein, 10 aa, Homo Sapiens
IMTPSTLAPL

SEQ ID NO: 10011 - protein, 10 aa, Homo Sapiens
VVRDFLHAQK

SEQ ID NO: 10012 - protein, 10 aa, Homo Sapiens
HVLGQDKVSY

SEQ ID NO: 10013 - protein, 10 aa, Homo Sapiens
NVCRKPFSFK

SEQ ID NO: 10014 - protein, 10 aa, Homo Sapiens
DIIDIPQLFK

SEQ ID NO: 10015 - protein, 10 aa, Homo Sapiens
PLPLAYAVLY

SEQ ID NO: 10016 - protein, 10 aa, Homo Sapiens
MLLASPGACF

SEQ ID NO: 10017 - protein, 10 aa, Homo Sapiens
LLASPGACFK

SEQ ID NO: 10018 - protein, 10 aa, Homo Sapiens
DLVNMLVLGK

SEQ ID NO: 10019 - protein, 10 aa, Homo Sapiens
EVYGTPGVDI

SEQ ID NO: 10020 - protein, 10 aa, Homo Sapiens
ELGYVQAPHK

SEQ ID NO: 10021 - protein, 10 aa, Homo Sapiens
VLGKHLGIPK

SEQ ID NO: 10022 - protein, 10 aa, Homo Sapiens
RVRNNTCFVD

SEQ ID NO: 10023 - protein, 10 aa, Homo Sapiens
ILGPDFGYVT

SEQ ID NO: 10024 - protein, 10 aa, Homo Sapiens
CIDWNREVLK

SEQ ID NO: 10025 - protein, 10 aa, Homo Sapiens
SLQRIVRVSL

SEQ ID NO: 10026 - protein, 10 aa, Homo Sapiens
TLVDIYGSVP

SEQ ID NO: 10027 - protein, 10 aa, Homo Sapiens
ALFDDHKLVL

SEQ ID NO: 10028 - protein, 10 aa, Homo Sapiens
VLHTSSYDAK

SEQ ID NO: 10029 - protein, 10 aa, Homo Sapiens
AELARKAGCK

SEQ ID NO: 10030 - protein, 10 aa, Homo Sapiens
VLKRELGLAE

SEQ ID NO: 10031 - protein, 10 aa, Homo Sapiens
CVAGVETLVD

SEQ ID NO: 10032 - protein, 10 aa, Homo Sapiens
HVQISYHSSH

SEQ ID NO: 10033 - protein, 10 aa, Homo Sapiens
RLHGDEERFF

SEQ ID NO: 10034 - protein, 10 aa, Homo Sapiens
FVDAVAELAR

SEQ ID NO: 10035 - protein, 10 aa, Homo Sapiens
SLLEPLGLHC

SEQ ID NO: 10036 - protein, 10 aa, Homo Sapiens
RVSLEHPTSA

SEQ ID NO: 10037 - protein, 10 aa, Homo Sapiens
AVLYLTCVDI

SEQ ID NO: 10038 - protein, 10 aa, Homo Sapiens
MVLRTQGPAA

SEQ ID NO: 10039 - protein, 10 aa, Homo Sapiens
AYRHVLGQDK

SEQ ID NO: 10040 - protein, 10 aa, Homo Sapiens
RVAPWIMTPS

SEQ ID NO: 10041 - protein, 10 aa, Homo Sapiens
NLEVSPPVVA

SEQ ID NO: 10042 - protein, 10 aa, Homo Sapiens
SGRRVTQVVR

SEQ ID NO: 10043 - protein, 10 aa, Homo Sapiens
KVQPPVELFV

SEQ ID NO: 10044 - protein, 10 aa, Homo Sapiens
FVPAPDGKGF

SEQ ID NO: 10045 - protein, 10 aa, Homo Sapiens
ALLFQGVVDD

SEQ ID NO: 10046 - protein, 10 aa, Homo Sapiens
ISINQVLSNK

SEQ ID NO: 10047 - protein, 10 aa, Homo Sapiens
SLEHPTSAVC

SEQ ID NO: 10048 - protein, 10 aa, Homo Sapiens
DIYISPNMER

SEQ ID NO: 10049 - protein, 10 aa, Homo Sapiens
VLRTQGPAAL

SEQ ID NO: 10050 - protein, 10 aa, Homo Sapiens
KVSYEVPRLH

SEQ ID NO: 10051 - protein, 10 aa, Homo Sapiens
PLEVYVCRVR

SEQ ID NO: 10052 - protein, 10 aa, Homo Sapiens
WIQDEMELGY

SEQ ID NO: 10053 - protein, 10 aa, Homo Sapiens
RILIGGNLPG

SEQ ID NO: 10054 - protein, 10 aa, Homo Sapiens
RALLFQGVVD

SEQ ID NO: 10055 - protein, 10 aa, Homo Sapiens
DLINYNKFVQ

SEQ ID NO: 10056 - protein, 10 aa, Homo Sapiens
EVHCGTNVCR

SEQ ID NO: 10057 - protein, 10 aa, Homo Sapiens
AVCVAGVETL

SEQ ID NO: 10058 - protein, 10 aa, Homo Sapiens
KLVLHTSSYD

SEQ ID NO: 10059 - protein, 10 aa, Homo Sapiens
TLLDDSNEDF

SEQ ID NO: 10060 - protein, 10 aa, Homo Sapiens
TLPPLEVYVC

SEQ ID NO: 10061 - protein, 10 aa, Homo Sapiens
YVCRVRNNTC

SEQ ID NO: 10062 - protein, 10 aa, Homo Sapiens
AVAELARKAG

SEQ ID NO: 10063 - protein, 10 aa, Homo Sapiens
ELARKAGCKL

SEQ ID NO: 10064 - protein, 10 aa, Homo Sapiens
KLTICPQAEN

SEQ ID NO: 10065 - protein, 10 aa, Homo Sapiens
TLPVVFDSPR

SEQ ID NO: 10066 - protein, 10 aa, Homo Sapiens
RILGPDFGYV

SEQ ID NO: 10067 - protein, 10 aa, Homo Sapiens
ILIGGNLPGS

SEQ ID NO: 10068 - protein, 10 aa, Homo Sapiens
ELFVDWLAVG

SEQ ID NO: 10069 - protein, 10 aa, Homo Sapiens
QVLSNKDLIN

SEQ ID NO: 10070 - protein, 10 aa, Homo Sapiens
VLSNKDLINY

SEQ ID NO: 10071 - protein, 10 aa, Homo Sapiens
IVVMNSPSND

SEQ ID NO: 10072 - protein, 10 aa, Homo Sapiens
DLEDMSVMVL

SEQ ID NO: 10073 - protein, 10 aa, Homo Sapiens
DVCEAYRHVL

SEQ ID NO: 10074 - protein, 10 aa, Homo Sapiens
EVPRLHGDEE

SEQ ID NO: 10075 - protein, 10 aa, Homo Sapiens
SPIFTDTVVF

SEQ ID NO: 10076 - protein, 10 aa, Homo Sapiens
PIFTDTVVFR

SEQ ID NO: 10077 - protein, 10 aa, Homo Sapiens
APHKTLPVVF

SEQ ID NO: 10078 - protein, 10 aa, Homo Sapiens
EVSPPVVANG

SEQ ID NO: 10079 - protein, 10 aa, Homo Sapiens
VSPPVVANGK

SEQ ID NO: 10080 - protein, 10 aa, Homo Sapiens
QVVRDFLHAQ

SEQ ID NO: 10081 - protein, 10 aa, Homo Sapiens
QGVVDDEQVK

SEQ ID NO: 10082 - protein, 10 aa, Homo Sapiens
QVKTISINQV

SEQ ID NO: 10083 - protein, 10 aa, Homo Sapiens
KVRSLLEPLG

SEQ ID NO: 10084 - protein, 10 aa, Homo Sapiens
RIVRVSLEHP

SEQ ID NO: 10085 - protein, 10 aa, Homo Sapiens
IVRVSLEHPT

SEQ ID NO: 10086 - protein, 10 aa, Homo Sapiens
LVDIYGSVPE

SEQ ID NO: 10087 - protein, 10 aa, Homo Sapiens
DIYGSVPEGT

SEQ ID NO: 10088 - protein, 10 aa, Homo Sapiens
YISPNMERGR

SEQ ID NO: 10089 - protein, 10 aa, Homo Sapiens
RERADTRRWR

SEQ ID NO: 10090 - protein, 10 aa, Homo Sapiens
VLYLTCVDIS

SEQ ID NO: 10091 - protein, 10 aa, Homo Sapiens
DLNCEGRQDR

SEQ ID NO: 10092 - protein, 10 aa, Homo Sapiens
GRQDRNFVDK

SEQ ID NO: 10093 - protein, 10 aa, Homo Sapiens
FVDKRQWVWG

SEQ ID NO: 10094 - protein, 10 aa, Homo Sapiens
WVWGPSGYGG

SEQ ID NO: 10095 - protein, 10 aa, Homo Sapiens
QVFHICGPED

SEQ ID NO: 10096 - protein, 10 aa, Homo Sapiens
NLPGSSGRRV

SEQ ID NO: 10097 - protein, 10 aa, Homo Sapiens
RVTQVVRDFL

SEQ ID NO: 10098 - protein, 10 aa, Homo Sapiens
WLAVGHVDEF

SEQ ID NO: 10099 - protein, 10 aa, Homo Sapiens
HVDEFLSFVP

SEQ ID NO: 10100 - protein, 10 aa, Homo Sapiens
CFKLFQEKQK

SEQ ID NO: 10101 - protein, 10 aa, Homo Sapiens
GVVDDEQVKT

SEQ ID NO: 10102 - protein, 10 aa, Homo Sapiens
VVDDEQVKTI

SEQ ID NO: 10103 - protein, 10 aa, Homo Sapiens
LINYNKFVQS

SEQ ID NO: 10104 - protein, 10 aa, Homo Sapiens
KTERKKATAF

SEQ ID NO: 10105 - protein, 10 aa, Homo Sapiens
LVNMLVLGKH

SEQ ID NO: 10106 - protein, 10 aa, Homo Sapiens
LVLGKHLGIP

SEQ ID NO: 10107 - protein, 10 aa, Homo Sapiens
IINGCCCLEE

SEQ ID NO: 10108 - protein, 10 aa, Homo Sapiens
CLEEKVRSLL

SEQ ID NO: 10109 - protein, 10 aa, Homo Sapiens
ERGRERADTR

SEQ ID NO: 10110 - protein, 10 aa, Homo Sapiens
EIIVVMNSPS

SEQ ID NO: 10111 - protein, 10 aa, Homo Sapiens
RQWVWGPSGY

SEQ ID NO: 10112 - protein, 10 aa, Homo Sapiens
SGYGGILLVN

SEQ ID NO: 10113 - protein, 10 aa, Homo Sapiens
ILLVNCDRDD

SEQ ID NO: 10114 - protein, 10 aa, Homo Sapiens
RDDPSCDVQD

SEQ ID NO: 10115 - protein, 10 aa, Homo Sapiens
CLQDLEDMSV

SEQ ID NO: 10116 - protein, 10 aa, Homo Sapiens
SYDAKRAQVF

SEQ ID NO: 10117 - protein, 10 aa, Homo Sapiens
HICGPEDVCE

SEQ ID NO: 10118 - protein, 10 aa, Homo Sapiens
GLSFPDAGFT

SEQ ID NO: 10119 - protein, 10 aa, Homo Sapiens
GLISFHVTLL

SEQ ID NO: 10120 - protein, 10 aa, Homo Sapiens
HVTLLDDSNE

SEQ ID NO: 10121 - protein, 10 aa, Homo Sapiens
TVVFRVAPWI

SEQ ID NO: 10122 - protein, 10 aa, Homo Sapiens
VVFRVAPWIM

SEQ ID NO: 10123 - protein, 10 aa, Homo Sapiens
EVYVCRVRNN

SEQ ID NO: 10124 - protein, 10 aa, Homo Sapiens
VDAVAELARK

SEQ ID NO: 10125 - protein, 10 aa, Homo Sapiens
YVTREPRDRS

SEQ ID NO: 10126 - protein, 10 aa, Homo Sapiens
PLGRILIGGN

SEQ ID NO: 10127 - protein, 10 aa, Homo Sapiens
LIGGNLPGSS

SEQ ID NO: 10128 - protein, 10 aa, Homo Sapiens
TISINQVLSN

SEQ ID NO: 10129 - protein, 10 aa, Homo Sapiens
FVQSCIDWNR

SEQ ID NO: 10130 - protein, 10 aa, Homo Sapiens
MLVLGKHLGI

SEQ ID NO: 10131 - protein, 10 aa, Homo Sapiens
GLHCTFIDDF

SEQ ID NO: 10132 - protein, 10 aa, Homo Sapiens
SVPEGTEMFE

SEQ ID NO: 10133 - protein, 10 aa, Homo Sapiens
RGRERADTRR

SEQ ID NO: 10134 - protein, 10 aa, Homo Sapiens
SSHEPLPLAY

SEQ ID NO: 10135 - protein, 10 aa, Homo Sapiens
LAYAVLYLTC

SEQ ID NO: 10136 - protein, 10 aa, Homo Sapiens
YLTCVDISLD

SEQ ID NO: 10137 - protein, 10 aa, Homo Sapiens
HVHCLQDLED

SEQ ID NO: 10138 - protein, 10 aa, Homo Sapiens
GPAALFDDHK

SEQ ID NO: 10139 - protein, 10 aa, Homo Sapiens
HKLVLHTSSY

SEQ ID NO: 10140 - protein, 10 aa, Homo Sapiens
SSYDAKRAQV

SEQ ID NO: 10141 - protein, 10 aa, Homo Sapiens
VLGQDKVSYE

SEQ ID NO: 10142 - protein, 10 aa, Homo Sapiens
ARKAGCKLTI

SEQ ID NO: 10143 - protein, 10 aa, Homo Sapiens
YVQAPHKTLP

SEQ ID NO: 10144 - protein, 10 aa, Homo Sapiens
KRILGPDFGY

SEQ ID NO: 10145 - protein, 10 aa, Homo Sapiens
LGPDFGYVTR

SEQ ID NO: 10146 - protein, 10 aa, Homo Sapiens
REPRDRSVSG

SEQ ID NO: 10147 - protein, 10 aa, Homo Sapiens
RDRSVSGLDS

SEQ ID NO: 10148 - protein, 10 aa, Homo Sapiens
SVSGLDSFGN

SEQ ID NO: 10149 - protein, 10 aa, Homo Sapiens
GLDSFGNLEV

SEQ ID NO: 10150 - protein, 10 aa, Homo Sapiens
AVGHVDEFLS

SEQ ID NO: 10151 - protein, 10 aa, Homo Sapiens
FLSFVPAPDG

SEQ ID NO: 10152 - protein, 10 aa, Homo Sapiens
KLFQEKQKCG

SEQ ID NO: 10153 - protein, 10 aa, Homo Sapiens
KCGHGRALLF

SEQ ID NO: 10154 - protein, 10 aa, Homo Sapiens
SNKDLINYNK

SEQ ID NO: 10155 - protein, 10 aa, Homo Sapiens
EVLKRELGLA

SEQ ID NO: 10156 - protein, 10 aa, Homo Sapiens
DIPQLFKTER

SEQ ID NO: 10157 - protein, 10 aa, Homo Sapiens
IPQLFKTERK

SEQ ID NO: 10158 - protein, 10 aa, Homo Sapiens
QLFKTERKKA

SEQ ID NO: 10159 - protein, 10 aa, Homo Sapiens
LLEPLGLHCT

SEQ ID NO: 10160 - protein, 10 aa, Homo Sapiens
QRIVRVSLEH

SEQ ID NO: 10161 - protein, 10 aa, Homo Sapiens
TLEIIVVMNS

SEQ ID NO: 10162 - protein, 10 aa, Homo Sapiens
IIVVMNSPSN

SEQ ID NO: 10163 - protein, 10 aa, Homo Sapiens
EPLPLAYAVL

SEQ ID NO: 10164 - protein, 10 aa, Homo Sapiens
DISLDCDLNC

SEQ ID NO: 10165 - protein, 10 aa, Homo Sapiens
LLVNCDRDDP

SEQ ID NO: 10166 - protein, 10 aa, Homo Sapiens
RTQGPAALFD

SEQ ID NO: 10167 - protein, 10 aa, Homo Sapiens
LVLHTSSYDA

SEQ ID NO: 10168 - protein, 10 aa, Homo Sapiens
ERFFVEGLSF

SEQ ID NO: 10169 - protein, 10 aa, Homo Sapiens
FVEGLSFPDA

SEQ ID NO: 10170 - protein, 10 aa, Homo Sapiens
APWIMTPSTL

SEQ ID NO: 10171 - protein, 10 aa, Homo Sapiens
VVFDSPRNGE

SEQ ID NO: 10172 - protein, 10 aa, Homo Sapiens
PVVANGKEYP

SEQ ID NO: 10173 - protein, 10 aa, Homo Sapiens
VVANGKEYPL

SEQ ID NO: 10174 - protein, 10 aa, Homo Sapiens
FLHAQKVQPP

SEQ ID NO: 10175 - protein, 10 aa, Homo Sapiens
LFVDWLAVGH

SEQ ID NO: 10176 - protein, 10 aa, Homo Sapiens
GLAECDIIDI

SEQ ID NO: 10177 - protein, 10 aa, Homo Sapiens
IDIPQLFKTE

SEQ ID NO: 10178 - protein, 10 aa, Homo Sapiens
PQLFKTERKK

SEQ ID NO: 10179 - protein, 10 aa, Homo Sapiens
HLGIPKPFGP

SEQ ID NO: 10180 - protein, 10 aa, Homo Sapiens
PIINGCCCLE

SEQ ID NO: 10181 - protein, 10 aa, Homo Sapiens
INGCCCLEEK

SEQ ID NO: 10182 - protein, 10 aa, Homo Sapiens
RSLLEPLGLH

SEQ ID NO: 10183 - protein, 10 aa, Homo Sapiens
MLHGEVHCGT

SEQ ID NO: 10184 - protein, 10 aa, Homo Sapiens
VHCGTNVCRK

SEQ ID NO: 10185 - protein, 10 aa, Homo Sapiens
GVDIYISPNM

SEQ ID NO: 10186 - protein, 10 aa, Homo Sapiens
RRWRFDATLE

SEQ ID NO: 10187 - protein, 10 aa, Homo Sapiens
ATLEIIVVMN

SEQ ID NO: 10188 - protein, 10 aa, Homo Sapiens
VVMNSPSNDL

SEQ ID NO: 10189 - protein, 10 aa, Homo Sapiens
DLNDSHVQIS

SEQ ID NO: 10190 - protein, 10 aa, Homo Sapiens
PLAYAVLYLT

SEQ ID NO: 10191 - protein, 10 aa, Homo Sapiens
CVDISLDCDL

SEQ ID NO: 10192 - protein, 10 aa, Homo Sapiens
SLDCDLNCEG

SEQ ID NO: 10193 - protein, 10 aa, Homo Sapiens
RQDRNFVDKR

SEQ ID NO: 10194 - protein, 10 aa, Homo Sapiens
GILLVNCDRD

SEQ ID NO: 10195 - protein, 10 aa, Homo Sapiens
DVQDNCDQHV

SEQ ID NO: 10196 - protein, 10 aa, Homo Sapiens
SVMVLRTQGP

SEQ ID NO: 10197 - protein, 10 aa, Homo Sapiens
EAYRHVLGQD

SEQ ID NO: 10198 - protein, 10 aa, Homo Sapiens
QDKVSYEVPR

SEQ ID NO: 10199 - protein, 10 aa, Homo Sapiens
TGLISFHVTL

SEQ ID NO: 10200 - protein, 10 aa, Homo Sapiens
LISFHVTLLD

SEQ ID NO: 10201 - protein, 10 aa, Homo Sapiens
LLDDSNEDFS

SEQ ID NO: 10202 - protein, 10 aa, Homo Sapiens
WIMTPSTLPP

SEQ ID NO: 10203 - protein, 10 aa, Homo Sapiens
PSTLPPLEVY

SEQ ID NO: 10204 - protein, 10 aa, Homo Sapiens
TICPQAENRN

SEQ ID NO: 10205 - protein, 10 aa, Homo Sapiens
MELGYVQAPH

SEQ ID NO: 10206 - protein, 10 aa, Homo Sapiens
PVVFDSPRNG

SEQ ID NO: 10207 - protein, 10 aa, Homo Sapiens
RNGELQDFPY

SEQ ID NO: 10208 - protein, 10 aa, Homo Sapiens
NGELQDFPYK

SEQ ID NO: 10209 - protein, 10 aa, Homo Sapiens
ELQDFPYKRI

SEQ ID NO: 10210 - protein, 10 aa, Homo Sapiens
PYKRILGPDF

SEQ ID NO: 10211 - protein, 10 aa, Homo Sapiens
TREPRDRSVS

SEQ ID NO: 10212 - protein, 10 aa, Homo Sapiens
ANGKEYPLGR

SEQ ID NO: 10213 - protein, 10 aa, Homo Sapiens
KEYPLGRILI

SEQ ID NO: 10214 - protein, 10 aa, Homo Sapiens
IGGNLPGSSG

SEQ ID NO: 10215 - protein, 10 aa, Homo Sapiens
PVELFVDWLA

SEQ ID NO: 10216 - protein, 10 aa, Homo Sapiens
FVDWLAVGHV

SEQ ID NO: 10217 - protein, 10 aa, Homo Sapiens
LSFVPAPDGK

SEQ ID NO: 10218 - protein, 10 aa, Homo Sapiens
KGFRMLLASP

SEQ ID NO: 10219 - protein, 10 aa, Homo Sapiens
ELGLAECDII

SEQ ID NO: 10220 - protein, 10 aa, Homo Sapiens
IIDIPQLFKT

SEQ ID NO: 10221 - protein, 10 aa, Homo Sapiens
ATAFFPDLVN

SEQ ID NO: 10222 - protein, 10 aa, Homo Sapiens
GIPKPFGPII

SEQ ID NO: 10223 - protein, 10 aa, Homo Sapiens
PLGLHCTFID

SEQ ID NO: 10224 - protein, 10 aa, Homo Sapiens
PYHMLHGEVH

SEQ ID NO: 10225 - protein, 10 aa, Homo Sapiens
LEHPTSAVCV

SEQ ID NO: 10226 - protein, 10 aa, Homo Sapiens
AGVETLVDIY

SEQ ID NO: 10227 - protein, 10 aa, Homo Sapiens
GVETLVDIYG

SEQ ID NO: 10228 - protein, 10 aa, Homo Sapiens
PEGTEMFEVY

SEQ ID NO: 10229 - protein, 10 aa, Homo Sapiens
TRRWRFDATL

SEQ ID NO: 10230 - protein, 10 aa, Homo Sapiens
RWRFDATLEI

SEQ ID NO: 10231 - protein, 10 aa, Homo Sapiens
NDLNDSHVQI

SEQ ID NO: 10232 - protein, 10 aa, Homo Sapiens
QISYHSSHEP

SEQ ID NO: 10233 - protein, 10 aa, Homo Sapiens
LVNCDRDDPS

SEQ ID NO: 10234 - protein, 10 aa, Homo Sapiens
QDLEDMSVMV

SEQ ID NO: 10235 - protein, 10 aa, Homo Sapiens
LRTQGPAALF

SEQ ID NO: 10236 - protein, 10 aa, Homo Sapiens
LSFPDAGFTG

SEQ ID NO: 10237 - protein, 10 aa, Homo Sapiens
AGFTGLISFH

SEQ ID NO: 10238 - protein, 10 aa, Homo Sapiens
STLPPLEVYV

SEQ ID NO: 10239 - protein, 10 aa, Homo Sapiens
LTICPQAENR

SEQ ID NO: 10240 - protein, 10 aa, Homo Sapiens
KTLPVVFDSP

SEQ ID NO: 10241 - protein, 10 aa, Homo Sapiens
GNLPGSSGRR

SEQ ID NO: 10242 - protein, 10 aa, Homo Sapiens
RMLLASPGAC

SEQ ID NO: 10243 - protein, 10 aa, Homo Sapiens
GACFKLFQEK

SEQ ID NO: 10244 - protein, 10 aa, Homo Sapiens
QEKQKCGHGR

SEQ ID NO: 10245 - protein, 10 aa, Homo Sapiens
LLFQGVVDDE

SEQ ID NO: 10246 - protein, 10 aa, Homo Sapiens
KTISINQVLS

SEQ ID NO: 10247 - protein, 10 aa, Homo Sapiens
SCIDWNREVL

SEQ ID NO: 10248 - protein, 10 aa, Homo Sapiens
IDWNREVLKR

SEQ ID NO: 10249 - protein, 10 aa, Homo Sapiens
TERKKATAFF

SEQ ID NO: 10250 - protein, 10 aa, Homo Sapiens
FIDDFTPYHM

SEQ ID NO: 10251 - protein, 10 aa, Homo Sapiens
TSAVCVAGVE

SEQ ID NO: 10252 - protein, 10 aa, Homo Sapiens
MERGRERADT

SEQ ID NO: 10253 - protein, 10 aa, Homo Sapiens
DATLEIIVVM

SEQ ID NO: 10254 - protein, 10 aa, Homo Sapiens
CDLNCEGRQD

SEQ ID NO: 10255 - protein, 10 aa, Homo Sapiens
VQDNCDQHVH

SEQ ID NO: 10256 - protein, 10 aa, Homo Sapiens
LFDDHKLVLH

SEQ ID NO: 10257 - protein, 10 aa, Homo Sapiens
YDAKRAQVFH

SEQ ID NO: 10258 - protein, 10 aa, Homo Sapiens
RHVLGQDKVS

SEQ ID NO: 10259 - protein, 10 aa, Homo Sapiens
VSYEVPRLHG

SEQ ID NO: 10260 - protein, 10 aa, Homo Sapiens
EGLSFPDAGF

SEQ ID NO: 10261 - protein, 10 aa, Homo Sapiens
PDAGFTGLIS

SEQ ID NO: 10262 - protein, 10 aa, Homo Sapiens
ASPIFTDTVV

SEQ ID NO: 10263 - protein, 10 aa, Homo Sapiens
LPPLEVYVCR

SEQ ID NO: 10264 - protein, 10 aa, Homo Sapiens
QDEMELGYVQ

SEQ ID NO: 10265 - protein, 10 aa, Homo Sapiens
DSPRNGELQD

SEQ ID NO: 10266 - protein, 10 aa, Homo Sapiens
SPRNGELQDF

SEQ ID NO: 10267 - protein, 10 aa, Homo Sapiens
PPVVANGKEY

SEQ ID NO: 10268 - protein, 10 aa, Homo Sapiens
PGSSGRRVTQ

SEQ ID NO: 10269 - protein, 10 aa, Homo Sapiens
RDFLHAQKVQ

SEQ ID NO: 10270 - protein, 10 aa, Homo Sapiens
DFLHAQKVQP

SEQ ID NO: 10271 - protein, 10 aa, Homo Sapiens
AQKVQPPVEL

SEQ ID NO: 10272 - protein, 10 aa, Homo Sapiens
VGHVDEFLSF

SEQ ID NO: 10273 - protein, 10 aa, Homo Sapiens
VPAPDGKGFR

SEQ ID NO: 10274 - protein, 10 aa, Homo Sapiens
GFRMLLASPG

SEQ ID NO: 10275 - protein, 10 aa, Homo Sapiens
ASPGACFKLF

SEQ ID NO: 10276 - protein, 10 aa, Homo Sapiens
SINQVLSNKD

SEQ ID NO: 10277 - protein, 10 aa, Homo Sapiens
INYNKFVQSC

SEQ ID NO: 10278 - protein, 10 aa, Homo Sapiens
CDIIDIPQLF

SEQ ID NO: 10279 - protein, 10 aa, Homo Sapiens
LEPLGLHCTF

SEQ ID NO: 10280 - protein, 10 aa, Homo Sapiens
SAVCVAGVET

SEQ ID NO: 10281 - protein, 10 aa, Homo Sapiens
GSVPEGTEMF

SEQ ID NO: 10282 - protein, 10 aa, Homo Sapiens
SPNMERGRER

SEQ ID NO: 10283 - protein, 10 aa, Homo Sapiens
SPSNDLNDSH

SEQ ID NO: 10284 - protein, 10 aa, Homo Sapiens
LNDSHVQISY

SEQ ID NO: 10285 - protein, 10 aa, Homo Sapiens
KRQWVWGPSG

SEQ ID NO: 10286 - protein, 10 aa, Homo Sapiens
GGILLVNCDR

SEQ ID NO: 10287 - protein, 10 aa, Homo Sapiens
LQDLEDMSVM

SEQ ID NO: 10288 - protein, 10 aa, Homo Sapiens
LEDMSVMVLR

SEQ ID NO: 10289 - protein, 10 aa, Homo Sapiens
QGPAALFDDH

SEQ ID NO: 10290 - protein, 10 aa, Homo Sapiens
AKRAQVFHIC

SEQ ID NO: 10291 - protein, 10 aa, Homo Sapiens
CGPEDVCEAY

SEQ ID NO: 10292 - protein, 10 aa, Homo Sapiens
GPEDVCEAYR

SEQ ID NO: 10293 - protein, 10 aa, Homo Sapiens
VPRLHGDEER

SEQ ID NO: 10294 - protein, 10 aa, Homo Sapiens
SNEDFSASPI

SEQ ID NO: 10295 - protein, 10 aa, Homo Sapiens
SASPIFTDTV

SEQ ID NO: 10296 - protein, 10 aa, Homo Sapiens
VCRVRNNTCF

SEQ ID NO: 10297 - protein, 10 aa, Homo Sapiens
NTCFVDAVAE

SEQ ID NO: 10298 - protein, 10 aa, Homo Sapiens
RKAGCKLTIC

SEQ ID NO: 10299 - protein, 10 aa, Homo Sapiens
DEMELGYVQA

SEQ ID NO: 10300 - protein, 10 aa, Homo Sapiens
DSFGNLEVSP

SEQ ID NO: 10301 - protein, 10 aa, Homo Sapiens
GNLEVSPPVV

SEQ ID NO: 10302 - protein, 10 aa, Homo Sapiens
LGRILIGGNL

SEQ ID NO: 10303 - protein, 10 aa, Homo Sapiens
GGNLPGSSGR

SEQ ID NO: 10304 - protein, 10 aa, Homo Sapiens
SSGRRVTQVV

SEQ ID NO: 10305 - protein, 10 aa, Homo Sapiens
RRVTQVVRDF

SEQ ID NO: 10306 - protein, 10 aa, Homo Sapiens
VDWLAVGHVD

SEQ ID NO: 10307 - protein, 10 aa, Homo Sapiens
DWLAVGHVDE

SEQ ID NO: 10308 - protein, 10 aa, Homo Sapiens
KQKCGHGRAL

SEQ ID NO: 10309 - protein, 10 aa, Homo Sapiens
QKCGHGRALL

SEQ ID NO: 10310 - protein, 10 aa, Homo Sapiens
REVLKRELGL

SEQ ID NO: 10311 - protein, 10 aa, Homo Sapiens
RELGLAECDI

SEQ ID NO: 10312 - protein, 10 aa, Homo Sapiens
FKTERKKATA

SEQ ID NO: 10313 - protein, 10 aa, Homo Sapiens
FPDLVNMLVL

SEQ ID NO: 10314 - protein, 10 aa, Homo Sapiens
GCCCLEEKVR

SEQ ID NO: 10315 - protein, 10 aa, Homo Sapiens
CTFIDDFTPY

SEQ ID NO: 10316 - protein, 10 aa, Homo Sapiens
TFIDDFTPYH

SEQ ID NO: 10317 - protein, 10 aa, Homo Sapiens
LQRIVRVSLE

SEQ ID NO: 10318 - protein, 10 aa, Homo Sapiens
VSLEHPTSAV

SEQ ID NO: 10319 - protein, 10 aa, Homo Sapiens
IYGSVPEGTE

SEQ ID NO: 10320 - protein, 10 aa, Homo Sapiens
ERADTRRWRF

SEQ ID NO: 10321 - protein, 10 aa, Homo Sapiens
ADTRRWRFDA

SEQ ID NO: 10322 - protein, 10 aa, Homo Sapiens
DTRRWRFDAT

SEQ ID NO: 10323 - protein, 10 aa, Homo Sapiens
NDSHVQISYH

SEQ ID NO: 10324 - protein, 10 aa, Homo Sapiens
SHEPLPLAYA

SEQ ID NO: 10325 - protein, 10 aa, Homo Sapiens
LPLAYAVLYL

SEQ ID NO: 10326 - protein, 10 aa, Homo Sapiens
EGRQDRNFVD

SEQ ID NO: 10327 - protein, 10 aa, Homo Sapiens
NCDRDDPSCD

SEQ ID NO: 10328 - protein, 10 aa, Homo Sapiens
CDVQDNCDQH

SEQ ID NO: 10329 - protein, 10 aa, Homo Sapiens
LHTSSYDAKR

SEQ ID NO: 10330 - protein, 10 aa, Homo Sapiens
FHICGPEDVC

SEQ ID NO: 10331 - protein, 10 aa, Homo Sapiens
PEDVCEAYRH

SEQ ID NO: 10332 - protein, 10 aa, Homo Sapiens
RFFVEGLSFP

SEQ ID NO: 10333 - protein, 10 aa, Homo Sapiens
FRVAPWIMTP

SEQ ID NO: 10334 - protein, 10 aa, Homo Sapiens
NNTCFVDAVA

SEQ ID NO: 10335 - protein, 10 aa, Homo Sapiens
CPQAENRNDR

SEQ ID NO: 10336 - protein, 10 aa, Homo Sapiens
AENRNDRWIQ

SEQ ID NO: 10337 - protein, 10 aa, Homo Sapiens
ENRNDRWIQD

SEQ ID NO: 10338 - protein, 10 aa, Homo Sapiens
RNDRWIQDEM

SEQ ID NO: 10339 - protein, 10 aa, Homo Sapiens
RWIQDEMELG

SEQ ID NO: 10340 - protein, 10 aa, Homo Sapiens
VQAPHKTLPV

SEQ ID NO: 10341 - protein, 10 aa, Homo Sapiens
GELQDFPYKR

SEQ ID NO: 10342 - protein, 10 aa, Homo Sapiens
EPRDRSVSGL

SEQ ID NO: 10343 - protein, 10 aa, Homo Sapiens
RSVSGLDSFG

SEQ ID NO: 10344 - protein, 10 aa, Homo Sapiens
SGLDSFGNLE

SEQ ID NO: 10345 - protein, 10 aa, Homo Sapiens
GRILIGGNLP

SEQ ID NO: 10346 - protein, 10 aa, Homo Sapiens
GRRVTQVVRD

SEQ ID NO: 10347 - protein, 10 aa, Homo Sapiens
VQPPVELFVD

SEQ ID NO: 10348 - protein, 10 aa, Homo Sapiens
GRALLFQGVV

SEQ ID NO: 10349 - protein, 10 aa, Homo Sapiens
LKRELGLAEC

SEQ ID NO: 10350 - protein, 10 aa, Homo Sapiens
KRELGLAECD

SEQ ID NO: 10351 - protein, 10 aa, Homo Sapiens
RKKATAFFPD

SEQ ID NO: 10352 - protein, 10 aa, Homo Sapiens
AFFPDLVNML

SEQ ID NO: 10353 - protein, 10 aa, Homo Sapiens
KHLGIPKPFG

SEQ ID NO: 10354 - protein, 10 aa, Homo Sapiens
LGIPKPFGPI

SEQ ID NO: 10355 - protein, 10 aa, Homo Sapiens
IPKPFGPIIN

SEQ ID NO: 10356 - protein, 10 aa, Homo Sapiens
TNVCRKPFSF

SEQ ID NO: 10357 - protein, 10 aa, Homo Sapiens
MSLQRIVRVS

SEQ ID NO: 10358 - protein, 10 aa, Homo Sapiens
FEVYGTPGVD

SEQ ID NO: 10359 - protein, 10 aa, Homo Sapiens
VYGTPGVDIY

SEQ ID NO: 10360 - protein, 10 aa, Homo Sapiens
RFDATLEIIV

SEQ ID NO: 10361 - protein, 10 aa, Homo Sapiens
LEIIVVMNSP

SEQ ID NO: 10362 - protein, 10 aa, Homo Sapiens
MNSPSNDLND

SEQ ID NO: 10363 - protein, 10 aa, Homo Sapiens
SNDLNDSHVQ

SEQ ID NO: 10364 - protein, 10 aa, Homo Sapiens
VQISYHSSHE

SEQ ID NO: 10365 - protein, 10 aa, Homo Sapiens
ISYHSSHEPL

SEQ ID NO: 10366 - protein, 10 aa, Homo Sapiens
NCEGRQDRNF

SEQ ID NO: 10367 - protein, 10 aa, Homo Sapiens
QDRNFVDKRQ

SEQ ID NO: 10368 - protein, 10 aa, Homo Sapiens
RNFVDKRQWV

SEQ ID NO: 10369 - protein, 10 aa, Homo Sapiens
GYGGILLVNC

SEQ ID NO: 10370 - protein, 10 aa, Homo Sapiens
QDNCDQHVHC

SEQ ID NO: 10371 - protein, 10 aa, Homo Sapiens
CDQHVHCLQD

SEQ ID NO: 10372 - protein, 10 aa, Homo Sapiens
VCEAYRHVLG

SEQ ID NO: 10373 - protein, 10 aa, Homo Sapiens
PRLHGDEERF

SEQ ID NO: 10374 - protein, 10 aa, Homo Sapiens
DAGFTGLISF

SEQ ID NO: 10375 - protein, 10 aa, Homo Sapiens
DSNEDFSASP

SEQ ID NO: 10376 - protein, 10 aa, Homo Sapiens
DFSASPIFTD

SEQ ID NO: 10377 - protein, 10 aa, Homo Sapiens
TDTVVFRVAP

SEQ ID NO: 10378 - protein, 10 aa, Homo Sapiens
QAPHKTLPVV

SEQ ID NO: 10379 - protein, 10 aa, Homo Sapiens
FDSPRNGELQ

SEQ ID NO: 10380 - protein, 10 aa, Homo Sapiens
QDFPYKRILG

SEQ ID NO: 10381 - protein, 10 aa, Homo Sapiens
VTREPRDRSV

SEQ ID NO: 10382 - protein, 10 aa, Homo Sapiens
DRSVSGLDSF

SEQ ID NO: 10383 - protein, 10 aa, Homo Sapiens
GSSGRRVTQV

SEQ ID NO: 10384 - protein, 10 aa, Homo Sapiens
QKVQPPVELF

SEQ ID NO: 10385 - protein, 10 aa, Homo Sapiens
QPPVELFVDW

SEQ ID NO: 10386 - protein, 10 aa, Homo Sapiens
VELFVDWLAV

SEQ ID NO: 10387 - protein, 10 aa, Homo Sapiens
EFLSFVPAPD

SEQ ID NO: 10388 - protein, 10 aa, Homo Sapiens
APDGKGFRML

SEQ ID NO: 10389 - protein, 10 aa, Homo Sapiens
DGKGFRMLLA

SEQ ID NO: 10390 - protein, 10 aa, Homo Sapiens
SPGACFKLFQ

SEQ ID NO: 10391 - protein, 10 aa, Homo Sapiens
GHGRALLFQG

SEQ ID NO: 10392 - protein, 10 aa, Homo Sapiens
KDLINYNKFV

SEQ ID NO: 10393 - protein, 10 aa, Homo Sapiens
KATAFFPDLV

SEQ ID NO: 10394 - protein, 10 aa, Homo Sapiens
PDLVNMLVLG

SEQ ID NO: 10395 - protein, 10 aa, Homo Sapiens
GKHLGIPKPF

SEQ ID NO: 10396 - protein, 10 aa, Homo Sapiens
DFTPYHMLHG

SEQ ID NO: 10397 - protein, 10 aa, Homo Sapiens
LHGEVHCGTN

SEQ ID NO: 10398 - protein, 10 aa, Homo Sapiens
CGTNVCRKPF

SEQ ID NO: 10399 - protein, 10 aa, Homo Sapiens
HPTSAVCVAG

SEQ ID NO: 10400 - protein, 10 aa, Homo Sapiens
PTSAVCVAGV

SEQ ID NO: 10401 - protein, 10 aa, Homo Sapiens
ETLVDIYGSV

SEQ ID NO: 10402 - protein, 10 aa, Homo Sapiens
EGTEMFEVYG

SEQ ID NO: 10403 - protein, 10 aa, Homo Sapiens
TEMFEVYGTP

SEQ ID NO: 10404 - protein, 10 aa, Homo Sapiens
EMFEVYGTPG

SEQ ID NO: 10405 - protein, 10 aa, Homo Sapiens
VDIYISPNME

SEQ ID NO: 10406 - protein, 10 aa, Homo Sapiens
IYISPNMERG

SEQ ID NO: 10407 - protein, 10 aa, Homo Sapiens
ISPNMERGRE

SEQ ID NO: 10408 - protein, 10 aa, Homo Sapiens
FDATLEIIVV

SEQ ID NO: 10409 - protein, 10 aa, Homo Sapiens
HEPLPLAYAV

SEQ ID NO: 10410 - protein, 10 aa, Homo Sapiens
AYAVLYLTCV

SEQ ID NO: 10411 - protein, 10 aa, Homo Sapiens
YAVLYLTCVD

SEQ ID NO: 10412 - protein, 10 aa, Homo Sapiens
ISLDCDLNCE

SEQ ID NO: 10413 - protein, 10 aa, Homo Sapiens
LDCDLNCEGR

SEQ ID NO: 10414 - protein, 10 aa, Homo Sapiens
NFVDKRQWVW

SEQ ID NO: 10415 - protein, 10 aa, Homo Sapiens
GPSGYGGILL

SEQ ID NO: 10416 - protein, 10 aa, Homo Sapiens
DRDDPSCDVQ

SEQ ID NO: 10417 - protein, 10 aa, Homo Sapiens
MSVMVLRTQG

SEQ ID NO: 10418 - protein, 10 aa, Homo Sapiens
AALFDDHKLV

SEQ ID NO: 10419 - protein, 10 aa, Homo Sapiens
DHKLVLHTSS

SEQ ID NO: 10420 - protein, 10 aa, Homo Sapiens
ICGPEDVCEA

SEQ ID NO: 10421 - protein, 10 aa, Homo Sapiens
HGDEERFFVE

SEQ ID NO: 10422 - protein, 10 aa, Homo Sapiens
GDEERFFVEG

SEQ ID NO: 10423 - protein, 10 aa, Homo Sapiens
FTGLISFHVT

SEQ ID NO: 10424 - protein, 10 aa, Homo Sapiens
ISFHVTLLDD

SEQ ID NO: 10425 - protein, 10 aa, Homo Sapiens
DDSNEDFSAS

SEQ ID NO: 10426 - protein, 10 aa, Homo Sapiens
IMTPSTLPPL

SEQ ID NO: 10427 - protein, 10 aa, Homo Sapiens
LEVYVCRVRN

SEQ ID NO: 10428 - protein, 10 aa, Homo Sapiens
VRNNTCFVDA

SEQ ID NO: 10429 - protein, 10 aa, Homo Sapiens
RNNTCFVDAV

SEQ ID NO: 10430 - protein, 10 aa, Homo Sapiens
DAVAELARKA

SEQ ID NO: 10431 - protein, 10 aa, Homo Sapiens
GCKLTICPQA

SEQ ID NO: 10432 - protein, 10 aa, Homo Sapiens
LGYVQAPHKT

SEQ ID NO: 10433 - protein, 10 aa, Homo Sapiens
PHKTLPVVFD

SEQ ID NO: 10434 - protein, 10 aa, Homo Sapiens
FPYKRILGPD

SEQ ID NO: 10435 - protein, 10 aa, Homo Sapiens
YKRILGPDFG

SEQ ID NO: 10436 - protein, 10 aa, Homo Sapiens
DFGYVTREPR

SEQ ID NO: 10437 - protein, 10 aa, Homo Sapiens
GYVTREPRDR

SEQ ID NO: 10438 - protein, 10 aa, Homo Sapiens
SFGNLEVSPP

SEQ ID NO: 10439 - protein, 10 aa, Homo Sapiens
LEVSPPVVAN

SEQ ID NO: 10440 - protein, 10 aa, Homo Sapiens
LPGSSGRRVT

SEQ ID NO: 10441 - protein, 10 aa, Homo Sapiens
HAQKVQPPVE

SEQ ID NO: 10442 - protein, 10 aa, Homo Sapiens
SFVPAPDGKG

SEQ ID NO: 10443 - protein, 10 aa, Homo Sapiens
LFQEKQKCGH

SEQ ID NO: 10444 - protein, 10 aa, Homo Sapiens
CGHGRALLFQ

SEQ ID NO: 10445 - protein, 10 aa, Homo Sapiens
HGRALLFQGV

SEQ ID NO: 10446 - protein, 10 aa, Homo Sapiens
VKTISINQVL

SEQ ID NO: 10447 - protein, 10 aa, Homo Sapiens
NKDLINYNKF

SEQ ID NO: 10448 - protein, 10 aa, Homo Sapiens
KPFGPIINGC

SEQ ID NO: 10449 - protein, 10 aa, Homo Sapiens
CCCLEEKVRS

SEQ ID NO: 10450 - protein, 10 aa, Homo Sapiens
CCLEEKVRSL

SEQ ID NO: 10451 - protein, 10 aa, Homo Sapiens
VRSLLEPLGL

SEQ ID NO: 10452 - protein, 10 aa, Homo Sapiens
EPLGLHCTFI

SEQ ID NO: 10453 - protein, 10 aa, Homo Sapiens
DDFTPYHMLH

SEQ ID NO: 10454 - protein, 10 aa, Homo Sapiens
TPYHMLHGEV

SEQ ID NO: 10455 - protein, 10 aa, Homo Sapiens
YHMLHGEVHC

SEQ ID NO: 10456 - protein, 10 aa, Homo Sapiens
CRKPFSFKWW

SEQ ID NO: 10457 - protein, 10 aa, Homo Sapiens
RKPFSFKWWN

SEQ ID NO: 10458 - protein, 10 aa, Homo Sapiens
FSFKWWNMVP

SEQ ID NO: 10459 - protein, 10 aa, Homo Sapiens
VRVSLEHPTS

SEQ ID NO: 10460 - protein, 10 aa, Homo Sapiens
EHPTSAVCVA

SEQ ID NO: 10461 - protein, 10 aa, Homo Sapiens
VAGVETLVDI

SEQ ID NO: 10462 - protein, 10 aa, Homo Sapiens
YGSVPEGTEM

SEQ ID NO: 10463 - protein, 10 aa, Homo Sapiens
PGVDIYISPN

SEQ ID NO: 10464 - protein, 10 aa, Homo Sapiens
NMERGRERAD

SEQ ID NO: 10465 - protein, 10 aa, Homo Sapiens
RADTRRWRFD

SEQ ID NO: 10466 - protein, 10 aa, Homo Sapiens
PSNDLNDSHV

SEQ ID NO: 10467 - protein, 10 aa, Homo Sapiens
YHSSHEPLPL

SEQ ID NO: 10468 - protein, 10 aa, Homo Sapiens
LYLTCVDISL

SEQ ID NO: 10469 - protein, 10 aa, Homo Sapiens
CEGRQDRNFV

SEQ ID NO: 10470 - protein, 10 aa, Homo Sapiens
VDKRQWVWGP

SEQ ID NO: 10471 - protein, 10 aa, Homo Sapiens
DKRQWVWGPS

SEQ ID NO: 10472 - protein, 10 aa, Homo Sapiens
VWGPSGYGGI

SEQ ID NO: 10473 - protein, 10 aa, Homo Sapiens
WGPSGYGGIL

SEQ ID NO: 10474 - protein, 10 aa, Homo Sapiens
CDRDDPSCDV

SEQ ID NO: 10475 - protein, 10 aa, Homo Sapiens
DMSVMVLRTQ

SEQ ID NO: 10476 - protein, 10 aa, Homo Sapiens
DDHKLVLHTS

SEQ ID NO: 10477 - protein, 10 aa, Homo Sapiens
DAKRAQVFHI

SEQ ID NO: 10478 - protein, 10 aa, Homo Sapiens
KRAQVFHICG

SEQ ID NO: 10479 - protein, 10 aa, Homo Sapiens
RAQVFHICGP

SEQ ID NO: 10480 - protein, 10 aa, Homo Sapiens
AQVFHICGPE

SEQ ID NO: 10481 - protein, 10 aa, Homo Sapiens
CEAYRHVLGQ

SEQ ID NO: 10482 - protein, 10 aa, Homo Sapiens
GQDKVSYEVP

SEQ ID NO: 10483 - protein, 10 aa, Homo Sapiens
YEVPRLHGDE

SEQ ID NO: 10484 - protein, 10 aa, Homo Sapiens
EERFFVEGLS

SEQ ID NO: 10485 - protein, 10 aa, Homo Sapiens
NEDFSASPIF

SEQ ID NO: 10486 - protein, 10 aa, Homo Sapiens
FTDTVVFRVA

SEQ ID NO: 10487 - protein, 10 aa, Homo Sapiens
VFRVAPWIMT

SEQ ID NO: 10488 - protein, 10 aa, Homo Sapiens
PWIMTPSTLP

SEQ ID NO: 10489 - protein, 10 aa, Homo Sapiens
TPSTLPPLEV

SEQ ID NO: 10490 - protein, 10 aa, Homo Sapiens
CFVDAVAELA

SEQ ID NO: 10491 - protein, 10 aa, Homo Sapiens
VAELARKAGC

SEQ ID NO: 10492 - protein, 10 aa, Homo Sapiens
CKLTICPQAE

SEQ ID NO: 10493 - protein, 10 aa, Homo Sapiens
QAENRNDRWI

SEQ ID NO: 10494 - protein, 10 aa, Homo Sapiens
NDRWIQDEME

SEQ ID NO: 10495 - protein, 10 aa, Homo Sapiens
IQDEMELGYV

SEQ ID NO: 10496 - protein, 10 aa, Homo Sapiens
GYVQAPHKTL

SEQ ID NO: 10497 - protein, 10 aa, Homo Sapiens
FGYVTREPRD

SEQ ID NO: 10498 - protein, 10 aa, Homo Sapiens
PRDRSVSGLD

SEQ ID NO: 10499 - protein, 10 aa, Homo Sapiens
LDSFGNLEVS

SEQ ID NO: 10500 - protein, 10 aa, Homo Sapiens
EYPLGRILIG

SEQ ID NO: 10501 - protein, 10 aa, Homo Sapiens
YPLGRILIGG

SEQ ID NO: 10502 - protein, 10 aa, Homo Sapiens
VTQVVRDFLH

SEQ ID NO: 10503 - protein, 10 aa, Homo Sapiens
GHVDEFLSFV

SEQ ID NO: 10504 - protein, 10 aa, Homo Sapiens
VDEFLSFVPA

SEQ ID NO: 10505 - protein, 10 aa, Homo Sapiens
PAPDGKGFRM

SEQ ID NO: 10506 - protein, 10 aa, Homo Sapiens
GKGFRMLLAS

SEQ ID NO: 10507 - protein, 10 aa, Homo Sapiens
PGACFKLFQE

SEQ ID NO: 10508 - protein, 10 aa, Homo Sapiens
KFVQSCIDWN

SEQ ID NO: 10509 - protein, 10 aa, Homo Sapiens
WNREVLKREL

SEQ ID NO: 10510 - protein, 10 aa, Homo Sapiens
LGLAECDIID

SEQ ID NO: 10511 - protein, 10 aa, Homo Sapiens
AECDIIDIPQ

SEQ ID NO: 10512 - protein, 10 aa, Homo Sapiens
ECDIIDIPQL

SEQ ID NO: 10513 - protein, 10 aa, Homo Sapiens
ERKKATAFFP

SEQ ID NO: 10514 - protein, 10 aa, Homo Sapiens
KKATAFFPDL

SEQ ID NO: 10515 - protein, 10 aa, Homo Sapiens
TAFFPDLVNM

SEQ ID NO: 10516 - protein, 10 aa, Homo Sapiens
VNMLVLGKHL

SEQ ID NO: 10517 - protein, 10 aa, Homo Sapiens
PFGPIINGCC

SEQ ID NO: 10518 - protein, 10 aa, Homo Sapiens
FGPIINGCCC

SEQ ID NO: 10519 - protein, 10 aa, Homo Sapiens
GPIINGCCCL

SEQ ID NO: 10520 - protein, 10 aa, Homo Sapiens
EEKVRSLLEP

SEQ ID NO: 10521 - protein, 10 aa, Homo Sapiens
HCTFIDDFTP

SEQ ID NO: 10522 - protein, 10 aa, Homo Sapiens
HGEVHCGTNV

SEQ ID NO: 10523 - protein, 10 aa, Homo Sapiens
GEVHCGTNVC

SEQ ID NO: 10524 - protein, 10 aa, Homo Sapiens
VCVAGVETLV

SEQ ID NO: 10525 - protein, 10 aa, Homo Sapiens
VDIYGSVPEG

SEQ ID NO: 10526 - protein, 10 aa, Homo Sapiens
YGTPGVDIYI

SEQ ID NO: 10527 - protein, 10 aa, Homo Sapiens
GRERADTRRW

SEQ ID NO: 10528 - protein, 10 aa, Homo Sapiens
SHVQISYHSS

SEQ ID NO: 10529 - protein, 10 aa, Homo Sapiens
LTCVDISLDC

SEQ ID NO: 10530 - protein, 10 aa, Homo Sapiens
VDISLDCDLN

SEQ ID NO: 10531 - protein, 10 aa, Homo Sapiens
DRNFVDKRQW

SEQ ID NO: 10532 - protein, 10 aa, Homo Sapiens
QWVWGPSGYG

SEQ ID NO: 10533 - protein, 10 aa, Homo Sapiens
PSGYGGILLV

SEQ ID NO: 10534 - protein, 10 aa, Homo Sapiens
VNCDRDDPSC

SEQ ID NO: 10535 - protein, 10 aa, Homo Sapiens
HCLQDLEDMS

SEQ ID NO: 10536 - protein, 10 aa, Homo Sapiens
EDMSVMVLRT

SEQ ID NO: 10537 - protein, 10 aa, Homo Sapiens
TQGPAALFDD

SEQ ID NO: 10538 - protein, 10 aa, Homo Sapiens
FDDHKLVLHT

SEQ ID NO: 10539 - protein, 10 aa, Homo Sapiens
HTSSYDAKRA

SEQ ID NO: 10540 - protein, 10 aa, Homo Sapiens
DEERFFVEGL

SEQ ID NO: 10541 - protein, 10 aa, Homo Sapiens
VEGLSFPDAG

SEQ ID NO: 10542 - protein, 10 aa, Homo Sapiens
SFPDAGFTGL

SEQ ID NO: 10543 - protein, 10 aa, Homo Sapiens
FPDAGFTGLI

SEQ ID NO: 10544 - protein, 10 aa, Homo Sapiens
VTLLDDSNED

SEQ ID NO: 10545 - protein, 10 aa, Homo Sapiens
IFTDTVVFRV

SEQ ID NO: 10546 - protein, 10 aa, Homo Sapiens
DTVVFRVAPW

SEQ ID NO: 10547 - protein, 10 aa, Homo Sapiens
PPLEVYVCRV

SEQ ID NO: 10548 - protein, 10 aa, Homo Sapiens
CRVRNNTCFV

SEQ ID NO: 10549 - protein, 10 aa, Homo Sapiens
TCFVDAVAEL

SEQ ID NO: 10550 - protein, 10 aa, Homo Sapiens
LARKAGCKLT

SEQ ID NO: 10551 - protein, 10 aa, Homo Sapiens
KAGCKLTICP

SEQ ID NO: 10552 - protein, 10 aa, Homo Sapiens
AGCKLTICPQ

SEQ ID NO: 10553 - protein, 10 aa, Homo Sapiens
DFPYKRILGP

SEQ ID NO: 10554 - protein, 10 aa, Homo Sapiens
NGKEYPLGRI

SEQ ID NO: 10555 - protein, 10 aa, Homo Sapiens
GKEYPLGRIL

SEQ ID NO: 10556 - protein, 10 aa, Homo Sapiens
TQVVRDFLHA

SEQ ID NO: 10557 - protein, 10 aa, Homo Sapiens
VRDFLHAQKV

SEQ ID NO: 10558 - protein, 10 aa, Homo Sapiens
LASPGACFKL

SEQ ID NO: 10559 - protein, 10 aa, Homo Sapiens
ACFKLFQEKQ

SEQ ID NO: 10560 - protein, 10 aa, Homo Sapiens
FQGVVDDEQV

SEQ ID NO: 10561 - protein, 10 aa, Homo Sapiens
DEQVKTISIN

SEQ ID NO: 10562 - protein, 10 aa, Homo Sapiens
NYNKFVQSCI

SEQ ID NO: 10563 - protein, 10 aa, Homo Sapiens
QSCIDWNREV

SEQ ID NO: 10564 - protein, 10 aa, Homo Sapiens
DWNREVLKRE

SEQ ID NO: 10565 - protein, 10 aa, Homo Sapiens
LEEKVRSLLE

SEQ ID NO: 10566 - protein, 10 aa, Homo Sapiens
EKVRSLLEPL

SEQ ID NO: 10567 - protein, 10 aa, Homo Sapiens
IDDFTPYHML

SEQ ID NO: 10568 - protein, 10 aa, Homo Sapiens
VCRKPFSFKW

SEQ ID NO: 10569 - protein, 10 aa, Homo Sapiens
KPFSFKWWNM

SEQ ID NO: 10570 - protein, 10 aa, Homo Sapiens
VPEGTEMFEV

SEQ ID NO: 10571 - protein, 10 aa, Homo Sapiens
GTPGVDIYIS

SEQ ID NO: 10572 - protein, 10 aa, Homo Sapiens
TPGVDIYISP

SEQ ID NO: 10573 - protein, 10 aa, Homo Sapiens
PNMERGRERA

SEQ ID NO: 10574 - protein, 10 aa, Homo Sapiens
DCDLNCEGRQ

SEQ ID NO: 10575 - protein, 10 aa, Homo Sapiens
QHVHCLQDLE

SEQ ID NO: 10576 - protein, 10 aa, Homo Sapiens
VMVLRTQGPA

SEQ ID NO: 10577 - protein, 10 aa, Homo Sapiens
PAALFDDHKL

SEQ ID NO: 10578 - protein, 10 aa, Homo Sapiens
VFHICGPEDV

SEQ ID NO: 10579 - protein, 10 aa, Homo Sapiens
LHGDEERFFV

SEQ ID NO: 10580 - protein, 10 aa, Homo Sapiens
GFTGLISFHV

SEQ ID NO: 10581 - protein, 10 aa, Homo Sapiens
FHVTLLDDSN

SEQ ID NO: 10582 - protein, 10 aa, Homo Sapiens
LDDSNEDFSA

SEQ ID NO: 10583 - protein, 10 aa, Homo Sapiens
FSASPIFTDT

SEQ ID NO: 10584 - protein, 10 aa, Homo Sapiens
VAPWIMTPST

SEQ ID NO: 10585 - protein, 10 aa, Homo Sapiens
ICPQAENRND

SEQ ID NO: 10586 - protein, 10 aa, Homo Sapiens
PQAENRNDRW

SEQ ID NO: 10587 - protein, 10 aa, Homo Sapiens
DRWIQDEMEL

SEQ ID NO: 10588 - protein, 10 aa, Homo Sapiens
EMELGYVQAP

SEQ ID NO: 10589 - protein, 10 aa, Homo Sapiens
PRNGELQDFP

SEQ ID NO: 10590 - protein, 10 aa, Homo Sapiens
PDFGYVTREP

SEQ ID NO: 10591 - protein, 10 aa, Homo Sapiens
VSGLDSFGNL

SEQ ID NO: 10592 - protein, 10 aa, Homo Sapiens
SPPVVANGKE

SEQ ID NO: 10593 - protein, 10 aa, Homo Sapiens
VANGKEYPLG

SEQ ID NO: 10594 - protein, 10 aa, Homo Sapiens
PPVELFVDWL

SEQ ID NO: 10595 - protein, 10 aa, Homo Sapiens
LAVGHVDEFL

SEQ ID NO: 10596 - protein, 10 aa, Homo Sapiens
DEFLSFVPAP

SEQ ID NO: 10597 - protein, 10 aa, Homo Sapiens
PDGKGFRMLL

SEQ ID NO: 10598 - protein, 10 aa, Homo Sapiens
FKLFQEKQKC

SEQ ID NO: 10599 - protein, 10 aa, Homo Sapiens
LFQGVVDDEQ

SEQ ID NO: 10600 - protein, 10 aa, Homo Sapiens
VDDEQVKTIS

SEQ ID NO: 10601 - protein, 10 aa, Homo Sapiens
DDEQVKTISI

SEQ ID NO: 10602 - protein, 10 aa, Homo Sapiens
INQVLSNKDL

SEQ ID NO: 10603 - protein, 10 aa, Homo Sapiens
LFKTERKKAT

SEQ ID NO: 10604 - protein, 10 aa, Homo Sapiens
FFPDLVNMLV

SEQ ID NO: 10605 - protein, 10 aa, Homo Sapiens
NMLVLGKHLG

SEQ ID NO: 10606 - protein, 10 aa, Homo Sapiens
LGLHCTFIDD

SEQ ID NO: 10607 - protein, 10 aa, Homo Sapiens
HMLHGEVHCG

SEQ ID NO: 10608 - protein, 10 aa, Homo Sapiens
VETLVDIYGS

SEQ ID NO: 10609 - protein, 10 aa, Homo Sapiens
WRFDATLEII

SEQ ID NO: 10610 - protein, 10 aa, Homo Sapiens
SYHSSHEPLP

SEQ ID NO: 10611 - protein, 10 aa, Homo Sapiens
TCVDISLDCD

SEQ ID NO: 10612 - protein, 10 aa, Homo Sapiens
LNCEGRQDRN

SEQ ID NO: 10613 - protein, 10 aa, Homo Sapiens
YGGILLVNCD

SEQ ID NO: 10614 - protein, 10 aa, Homo Sapiens
PSCDVQDNCD

SEQ ID NO: 10615 - protein, 10 aa, Homo Sapiens
SCDVQDNCDQ

SEQ ID NO: 10616 - protein, 10 aa, Homo Sapiens
DNCDQHVHCL

SEQ ID NO: 10617 - protein, 10 aa, Homo Sapiens
VHCLQDLEDM

SEQ ID NO: 10618 - protein, 10 aa, Homo Sapiens
TSSYDAKRAQ

SEQ ID NO: 10619 - protein, 10 aa, Homo Sapiens
LGQDKVSYEV

SEQ ID NO: 10620 - protein, 10 aa, Homo Sapiens
SYEVPRLHGD

SEQ ID NO: 10621 - protein, 10 aa, Homo Sapiens
FFVEGLSFPD

SEQ ID NO: 10622 - protein, 10 aa, Homo Sapiens
SFHVTLLDDS

SEQ ID NO: 10623 - protein, 10 aa, Homo Sapiens
EDFSASPIFT

SEQ ID NO: 10624 - protein, 10 aa, Homo Sapiens
MTPSTLPPLE

SEQ ID NO: 10625 - protein, 10 aa, Homo Sapiens
VYVCRVRNNT

SEQ ID NO: 10626 - protein, 10 aa, Homo Sapiens
NRNDRWIQDE

SEQ ID NO: 10627 - protein, 10 aa, Homo Sapiens
HKTLPVVFDS

SEQ ID NO: 10628 - protein, 10 aa, Homo Sapiens
VFDSPRNGEL

SEQ ID NO: 10629 - protein, 10 aa, Homo Sapiens
GPDFGYVTRE

SEQ ID NO: 10630 - protein, 10 aa, Homo Sapiens
FGNLEVSPPV

SEQ ID NO: 10631 - protein, 10 aa, Homo Sapiens
LHAQKVQPPV

SEQ ID NO: 10632 - protein, 10 aa, Homo Sapiens
FRMLLASPGA

SEQ ID NO: 10633 - protein, 10 aa, Homo Sapiens
FQEKQKCGHG

SEQ ID NO: 10634 - protein, 10 aa, Homo Sapiens
EKQKCGHGRA

SEQ ID NO: 10635 - protein, 10 aa, Homo Sapiens
NQVLSNKDLI

SEQ ID NO: 10636 - protein, 10 aa, Homo Sapiens
YNKFVQSCID

SEQ ID NO: 10637 - protein, 10 aa, Homo Sapiens
NREVLKRELG

SEQ ID NO: 10638 - protein, 10 aa, Homo Sapiens
LGKHLGIPKP

SEQ ID NO: 10639 - protein, 10 aa, Homo Sapiens
PFSFKWWNMV

SEQ ID NO: 10640 - protein, 10 aa, Homo Sapiens
TLAPLEVYVC

SEQ ID NO: 10641 - protein, 10 aa, Homo Sapiens
WIMTPSTLAP

SEQ ID NO: 10642 - protein, 10 aa, Homo Sapiens
PSTLAPLEVY

SEQ ID NO: 10643 - protein, 10 aa, Homo Sapiens
STLAPLEVYV

SEQ ID NO: 10644 - protein, 10 aa, Homo Sapiens
LAPLEVYVCR

SEQ ID NO: 10645 - protein, 10 aa, Homo Sapiens
IMTPSTLAPL

SEQ ID NO: 10646 - protein, 10 aa, Homo Sapiens
APLEVYVCRV

SEQ ID NO: 10647 - protein, 10 aa, Homo Sapiens
PWIMTPSTLA

SEQ ID NO: 10648 - protein, 10 aa, Homo Sapiens
TPSTLAPLEV

SEQ ID NO: 10649 - protein, 10 aa, Homo Sapiens
MTPSTLAPLE

SEQ ID NO: 10650 - protein, 10 aa, Homo Sapiens
FVPVPDGKGF

SEQ ID NO: 10651 - protein, 10 aa, Homo Sapiens
PVPDGKGFRM

SEQ ID NO: 10652 - protein, 10 aa, Homo Sapiens
LSFVPVPDGK

SEQ ID NO: 10653 - protein, 10 aa, Homo Sapiens
FLSFVPVPDG

SEQ ID NO: 10654 - protein, 10 aa, Homo Sapiens
VPVPDGKGFR

SEQ ID NO: 10655 - protein, 10 aa, Homo Sapiens
EFLSFVPVPD

SEQ ID NO: 10656 - protein, 10 aa, Homo Sapiens
DEFLSFVPVP

SEQ ID NO: 10657 - protein, 10 aa, Homo Sapiens
SFVPVPDGKG

SEQ ID NO: 10658 - protein, 10 aa, Homo Sapiens
VDEFLSFVPV

SEQ ID NO: 10659 - protein, 10 aa, Homo Sapiens
VPDGKGFRML

SEQ ID NO: 10660 - protein, 10 aa, Homo Sapiens
DLEDMSVMVL

SEQ ID NO: 10661 - protein, 10 aa, Homo Sapiens
DVCEAYRHVL

SEQ ID NO: 10662 - protein, 10 aa, Homo Sapiens
CTFIDDFTPY

SEQ ID NO: 10663 - protein, 10 aa, Homo Sapiens
HVLGQDKVSY

SEQ ID NO: 10664 - protein, 10 aa, Homo Sapiens
ELARKAGCKL

SEQ ID NO: 10665 - protein, 10 aa, Homo Sapiens
EVSPPVVANG

SEQ ID NO: 10666 - protein, 10 aa, Homo Sapiens
WLAVGHVDEF

SEQ ID NO: 10667 - protein, 10 aa, Homo Sapiens
GLISFHVTLL

SEQ ID NO: 10668 - protein, 10 aa, Homo Sapiens
VLSNKDLINY

SEQ ID NO: 10669 - protein, 10 aa, Homo Sapiens
AFFPDLVNML

SEQ ID NO: 10670 - protein, 10 aa, Homo Sapiens
AVCVAGVETL

SEQ ID NO: 10671 - protein, 10 aa, Homo Sapiens
WIQDEMELGY

SEQ ID NO: 10672 - protein, 10 aa, Homo Sapiens
FVPAPDGKGF

SEQ ID NO: 10673 - protein, 10 aa, Homo Sapiens
GLHCTFIDDF

SEQ ID NO: 10674 - protein, 10 aa, Homo Sapiens
ETLVDIYGSV

SEQ ID NO: 10675 - protein, 10 aa, Homo Sapiens
GVDIYISPNM

SEQ ID NO: 10676 - protein, 10 aa, Homo Sapiens
DTRRWRFDAT

SEQ ID NO: 10677 - protein, 10 aa, Homo Sapiens
EPLPLAYAVL

SEQ ID NO: 10678 - protein, 10 aa, Homo Sapiens
DKVSYEVPRL

SEQ ID NO: 10679 - protein, 10 aa, Homo Sapiens
SFPDAGFTGL

SEQ ID NO: 10680 - protein, 10 aa, Homo Sapiens
DAGFTGLISF

SEQ ID NO: 10681 - protein, 10 aa, Homo Sapiens
DTVVFRVAPW

SEQ ID NO: 10682 - protein, 10 aa, Homo Sapiens
EVYVCRVRNN

SEQ ID NO: 10683 - protein, 10 aa, Homo Sapiens
EPRDRSVSGL

SEQ ID NO: 10684 - protein, 10 aa, Homo Sapiens
DRSVSGLDSF

SEQ ID NO: 10685 - protein, 10 aa, Homo Sapiens
ELFVDWLAVG

SEQ ID NO: 10686 - protein, 10 aa, Homo Sapiens
EVLKRELGLA

SEQ ID NO: 10687 - protein, 10 aa, Homo Sapiens
ECDIIDIPQL

SEQ ID NO: 10688 - protein, 10 aa, Homo Sapiens
KTERKKATAF

SEQ ID NO: 10689 - protein, 10 aa, Homo Sapiens
FIDDFTPYHM

SEQ ID NO: 10690 - protein, 10 aa, Homo Sapiens
DLNDSHVQIS

SEQ ID NO: 10691 - protein, 10 aa, Homo Sapiens
PLPLAYAVLY

SEQ ID NO: 10692 - protein, 10 aa, Homo Sapiens
RLHGDEERFF

SEQ ID NO: 10693 - protein, 10 aa, Homo Sapiens
VVFRVAPWIM

SEQ ID NO: 10694 - protein, 10 aa, Homo Sapiens
ELQDFPYKRI

SEQ ID NO: 10695 - protein, 10 aa, Homo Sapiens
DIYGSVPEGT

SEQ ID NO: 10696 - protein, 10 aa, Homo Sapiens
EVYGTPGVDI

SEQ ID NO: 10697 - protein, 10 aa, Homo Sapiens
ERADTRRWRF

SEQ ID NO: 10698 - protein, 10 aa, Homo Sapiens
DATLEIIVVM

SEQ ID NO: 10699 - protein, 10 aa, Homo Sapiens
EIIVVMNSPS

SEQ ID NO: 10700 - protein, 10 aa, Homo Sapiens
CVDISLDCDL

SEQ ID NO: 10701 - protein, 10 aa, Homo Sapiens
DVQDNCDQHV

SEQ ID NO: 10702 - protein, 10 aa, Homo Sapiens
DNCDQHVHCL

SEQ ID NO: 10703 - protein, 10 aa, Homo Sapiens
DQHVHCLQDL

SEQ ID NO: 10704 - protein, 10 aa, Homo Sapiens
ALFDDHKLVL

SEQ ID NO: 10705 - protein, 10 aa, Homo Sapiens
DEERFFVEGL

SEQ ID NO: 10706 - protein, 10 aa, Homo Sapiens
ERFFVEGLSF

SEQ ID NO: 10707 - protein, 10 aa, Homo Sapiens
EGLSFPDAGF

SEQ ID NO: 10708 - protein, 10 aa, Homo Sapiens
TLLDDSNEDF

SEQ ID NO: 10709 - protein, 10 aa, Homo Sapiens
VVANGKEYPL

SEQ ID NO: 10710 - protein, 10 aa, Homo Sapiens
RVTQVVRDFL

SEQ ID NO: 10711 - protein, 10 aa, Homo Sapiens
MLLASPGACF

SEQ ID NO: 10712 - protein, 10 aa, Homo Sapiens
DIIDIPQLFK

SEQ ID NO: 10713 - protein, 10 aa, Homo Sapiens
DIPQLFKTER

SEQ ID NO: 10714 - protein, 10 aa, Homo Sapiens
DLVNMLVLGK

SEQ ID NO: 10715 - protein, 10 aa, Homo Sapiens
CLEEKVRSLL

SEQ ID NO: 10716 - protein, 10 aa, Homo Sapiens
DFTPYHMLHG

SEQ ID NO: 10717 - protein, 10 aa, Homo Sapiens
SLQRIVRVSL

SEQ ID NO: 10718 - protein, 10 aa, Homo Sapiens
DIYISPNMER

SEQ ID NO: 10719 - protein, 10 aa, Homo Sapiens
ATLEIIVVMN

SEQ ID NO: 10720 - protein, 10 aa, Homo Sapiens
VVMNSPSNDL

SEQ ID NO: 10721 - protein, 10 aa, Homo Sapiens
VLRTQGPAAL

SEQ ID NO: 10722 - protein, 10 aa, Homo Sapiens
EVPRLHGDEE

SEQ ID NO: 10723 - protein, 10 aa, Homo Sapiens
DFPYKRILGP

SEQ ID NO: 10724 - protein, 10 aa, Homo Sapiens
ILIGGNLPGS

SEQ ID NO: 10725 - protein, 10 aa, Homo Sapiens
EKVRSLLEPL

SEQ ID NO: 10726 - protein, 10 aa, Homo Sapiens
GTPGVDIYIS

SEQ ID NO: 10727 - protein, 10 aa, Homo Sapiens
DISLDCDLNC

SEQ ID NO: 10728 - protein, 10 aa, Homo Sapiens
FVEGLSFPDA

SEQ ID NO: 10729 - protein, 10 aa, Homo Sapiens
PIFTDTVVFR

SEQ ID NO: 10730 - protein, 10 aa, Homo Sapiens
RVAPWIMTPS

SEQ ID NO: 10731 - protein, 10 aa, Homo Sapiens
KTLPVVFDSP

SEQ ID NO: 10732 - protein, 10 aa, Homo Sapiens
VFDSPRNGEL

SEQ ID NO: 10733 - protein, 10 aa, Homo Sapiens
ASPGACFKLF

SEQ ID NO: 10734 - protein, 10 aa, Homo Sapiens
EVHCGTNVCR

SEQ ID NO: 10735 - protein, 10 aa, Homo Sapiens
PTSAVCVAGV

SEQ ID NO: 10736 - protein, 10 aa, Homo Sapiens
AGVETLVDIY

SEQ ID NO: 10737 - protein, 10 aa, Homo Sapiens
DFSASPIFTD

SEQ ID NO: 10738 - protein, 10 aa, Homo Sapiens
TCFVDAVAEL

SEQ ID NO: 10739 - protein, 10 aa, Homo Sapiens
DRWIQDEMEL

SEQ ID NO: 10740 - protein, 10 aa, Homo Sapiens
ELGYVQAPHK

SEQ ID NO: 10741 - protein, 10 aa, Homo Sapiens
RILGPDFGYV

SEQ ID NO: 10742 - protein, 10 aa, Homo Sapiens
FVDWLAVGHV

SEQ ID NO: 10743 - protein, 10 aa, Homo Sapiens
APDGKGFRML

SEQ ID NO: 10744 - protein, 10 aa, Homo Sapiens
VVDDEQVKTI

SEQ ID NO: 10745 - protein, 10 aa, Homo Sapiens
QVKTISINQV

SEQ ID NO: 10746 - protein, 10 aa, Homo Sapiens
NKDLINYNKF

SEQ ID NO: 10747 - protein, 10 aa, Homo Sapiens
DLINYNKFVQ

SEQ ID NO: 10748 - protein, 10 aa, Homo Sapiens
LINYNKFVQS

SEQ ID NO: 10749 - protein, 10 aa, Homo Sapiens
IIDIPQLFKT

SEQ ID NO: 10750 - protein, 10 aa, Homo Sapiens
TAFFPDLVNM

SEQ ID NO: 10751 - protein, 10 aa, Homo Sapiens
LVLGKHLGIP

SEQ ID NO: 10752 - protein, 10 aa, Homo Sapiens
FTPYHMLHGE

SEQ ID NO: 10753 - protein, 10 aa, Homo Sapiens
RIVRVSLEHP

SEQ ID NO: 10754 - protein, 10 aa, Homo Sapiens
GTEMFEVYGT

SEQ ID NO: 10755 - protein, 10 aa, Homo Sapiens
DLNCEGRQDR

SEQ ID NO: 10756 - protein, 10 aa, Homo Sapiens
FTDTVVFRVA

SEQ ID NO: 10757 - protein, 10 aa, Homo Sapiens
IMTPSTLPPL

SEQ ID NO: 10758 - protein, 10 aa, Homo Sapiens
TLPPLEVYVC

SEQ ID NO: 10759 - protein, 10 aa, Homo Sapiens
SPRNGELQDF

SEQ ID NO: 10760 - protein, 10 aa, Homo Sapiens
QVVRDFLHAQ

SEQ ID NO: 10761 - protein, 10 aa, Homo Sapiens
QKVQPPVELF

SEQ ID NO: 10762 - protein, 10 aa, Homo Sapiens
VGHVDEFLSF

SEQ ID NO: 10763 - protein, 10 aa, Homo Sapiens
LLFQGVVDDE

SEQ ID NO: 10764 - protein, 10 aa, Homo Sapiens
TISINQVLSN

SEQ ID NO: 10765 - protein, 10 aa, Homo Sapiens
GLAECDIIDI

SEQ ID NO: 10766 - protein, 10 aa, Homo Sapiens
LVNMLVLGKH

SEQ ID NO: 10767 - protein, 10 aa, Homo Sapiens
CCLEEKVRSL

SEQ ID NO: 10768 - protein, 10 aa, Homo Sapiens
NVCRKPFSFK

SEQ ID NO: 10769 - protein, 10 aa, Homo Sapiens
SVPEGTEMFE

SEQ ID NO: 10770 - protein, 10 aa, Homo Sapiens
PEGTEMFEVY

SEQ ID NO: 10771 - protein, 10 aa, Homo Sapiens
VYGTPGVDIY

SEQ ID NO: 10772 - protein, 10 aa, Homo Sapiens
TLEIIVVMNS

SEQ ID NO: 10773 - protein, 10 aa, Homo Sapiens
LQDLEDMSVM

SEQ ID NO: 10774 - protein, 10 aa, Homo Sapiens
QVFHICGPED

SEQ ID NO: 10775 - protein, 10 aa, Homo Sapiens
CGPEDVCEAY

SEQ ID NO: 10776 - protein, 10 aa, Homo Sapiens
VLGQDKVSYE

SEQ ID NO: 10777 - protein, 10 aa, Homo Sapiens
FTGLISFHVT

SEQ ID NO: 10778 - protein, 10 aa, Homo Sapiens
PSTLPPLEVY

SEQ ID NO: 10779 - protein, 10 aa, Homo Sapiens
AVAELARKAG

SEQ ID NO: 10780 - protein, 10 aa, Homo Sapiens
DEMELGYVQA

SEQ ID NO: 10781 - protein, 10 aa, Homo Sapiens
VVFDSPRNGE

SEQ ID NO: 10782 - protein, 10 aa, Homo Sapiens
RRVTQVVRDF

SEQ ID NO: 10783 - protein, 10 aa, Homo Sapiens
DFLHAQKVQP

SEQ ID NO: 10784 - protein, 10 aa, Homo Sapiens
PPVELFVDWL

SEQ ID NO: 10785 - protein, 10 aa, Homo Sapiens
DEFLSFVPAP

SEQ ID NO: 10786 - protein, 10 aa, Homo Sapiens
EFLSFVPAPD

SEQ ID NO: 10787 - protein, 10 aa, Homo Sapiens
KTISINQVLS

SEQ ID NO: 10788 - protein, 10 aa, Homo Sapiens
ELGLAECDII

SEQ ID NO: 10789 - protein, 10 aa, Homo Sapiens
KKATAFFPDL

SEQ ID NO: 10790 - protein, 10 aa, Homo Sapiens
LLEPLGLHCT

SEQ ID NO: 10791 - protein, 10 aa, Homo Sapiens
IDDFTPYHML

SEQ ID NO: 10792 - protein, 10 aa, Homo Sapiens
CVAGVETLVD

SEQ ID NO: 10793 - protein, 10 aa, Homo Sapiens
GSVPEGTEMF

SEQ ID NO: 10794 - protein, 10 aa, Homo Sapiens
YISPNMERGR

SEQ ID NO: 10795 - protein, 10 aa, Homo Sapiens
LNDSHVQISY

SEQ ID NO: 10796 - protein, 10 aa, Homo Sapiens
SSHEPLPLAY

SEQ ID NO: 10797 - protein, 10 aa, Homo Sapiens
PLAYAVLYLT

SEQ ID NO: 10798 - protein, 10 aa, Homo Sapiens
YLTCVDISLD

SEQ ID NO: 10799 - protein, 10 aa, Homo Sapiens
NCEGRQDRNF

SEQ ID NO: 10800 - protein, 10 aa, Homo Sapiens
FVDKRQWVWG

SEQ ID NO: 10801 - protein, 10 aa, Homo Sapiens
WVWGPSGYGG

SEQ ID NO: 10802 - protein, 10 aa, Homo Sapiens
DDPSCDVQDN

SEQ ID NO: 10803 - protein, 10 aa, Homo Sapiens
LFDDHKLVLH

SEQ ID NO: 10804 - protein, 10 aa, Homo Sapiens
VLHTSSYDAK

SEQ ID NO: 10805 - protein, 10 aa, Homo Sapiens
HICGPEDVCE

SEQ ID NO: 10806 - protein, 10 aa, Homo Sapiens
RFFVEGLSFP

SEQ ID NO: 10807 - protein, 10 aa, Homo Sapiens
SPIFTDTVVF

SEQ ID NO: 10808 - protein, 10 aa, Homo Sapiens
MTPSTLPPLE

SEQ ID NO: 10809 - protein, 10 aa, Homo Sapiens
STLPPLEVYV

SEQ ID NO: 10810 - protein, 10 aa, Homo Sapiens
LTICPQAENR

SEQ ID NO: 10811 - protein, 10 aa, Homo Sapiens
TICPQAENRN

SEQ ID NO: 10812 - protein, 10 aa, Homo Sapiens
KRILGPDFGY

SEQ ID NO: 10813 - protein, 10 aa, Homo Sapiens
VTREPRDRSV

SEQ ID NO: 10814 - protein, 10 aa, Homo Sapiens
SVSGLDSFGN

SEQ ID NO: 10815 - protein, 10 aa, Homo Sapiens
VSGLDSFGNL

SEQ ID NO: 10816 - protein, 10 aa, Homo Sapiens
PLGRILIGGN

SEQ ID NO: 10817 - protein, 10 aa, Homo Sapiens
LIGGNLPGSS

SEQ ID NO: 10818 - protein, 10 aa, Homo Sapiens
VVRDFLHAQK

SEQ ID NO: 10819 - protein, 10 aa, Homo Sapiens
FLHAQKVQPP

SEQ ID NO: 10820 - protein, 10 aa, Homo Sapiens
HVDEFLSFVP

SEQ ID NO: 10821 - protein, 10 aa, Homo Sapiens
DGKGFRMLLA

SEQ ID NO: 10822 - protein, 10 aa, Homo Sapiens
ALLFQGVVDD

SEQ ID NO: 10823 - protein, 10 aa, Homo Sapiens
GVVDDEQVKT

SEQ ID NO: 10824 - protein, 10 aa, Homo Sapiens
CDIIDIPQLF

SEQ ID NO: 10825 - protein, 10 aa, Homo Sapiens
FPDLVNMLVL

SEQ ID NO: 10826 - protein, 10 aa, Homo Sapiens
GIPKPFGPII

SEQ ID NO: 10827 - protein, 10 aa, Homo Sapiens
IINGCCCLEE

SEQ ID NO: 10828 - protein, 10 aa, Homo Sapiens
LVDIYGSVPE

SEQ ID NO: 10829 - protein, 10 aa, Homo Sapiens
IIVVMNSPSN

SEQ ID NO: 10830 - protein, 10 aa, Homo Sapiens
IVVMNSPSND

SEQ ID NO: 10831 - protein, 10 aa, Homo Sapiens
HVQISYHSSH

SEQ ID NO: 10832 - protein, 10 aa, Homo Sapiens
LPLAYAVLYL

SEQ ID NO: 10833 - protein, 10 aa, Homo Sapiens
VLYLTCVDIS

SEQ ID NO: 10834 - protein, 10 aa, Homo Sapiens
RQWVWGPSGY

SEQ ID NO: 10835 - protein, 10 aa, Homo Sapiens
VHCLQDLEDM

SEQ ID NO: 10836 - protein, 10 aa, Homo Sapiens
EDMSVMVLRT

SEQ ID NO: 10837 - protein, 10 aa, Homo Sapiens
SVMVLRTQGP

SEQ ID NO: 10838 - protein, 10 aa, Homo Sapiens
MVLRTQGPAA

SEQ ID NO: 10839 - protein, 10 aa, Homo Sapiens
LRTQGPAALF

SEQ ID NO: 10840 - protein, 10 aa, Homo Sapiens
RTQGPAALFD

SEQ ID NO: 10841 - protein, 10 aa, Homo Sapiens
HKLVLHTSSY

SEQ ID NO: 10842 - protein, 10 aa, Homo Sapiens
HTSSYDAKRA

SEQ ID NO: 10843 - protein, 10 aa, Homo Sapiens
SYDAKRAQVF

SEQ ID NO: 10844 - protein, 10 aa, Homo Sapiens
DAKRAQVFHI

SEQ ID NO: 10845 - protein, 10 aa, Homo Sapiens
HVTLLDDSNE

SEQ ID NO: 10846 - protein, 10 aa, Homo Sapiens
DDSNEDFSAS

SEQ ID NO: 10847 - protein, 10 aa, Homo Sapiens
NEDFSASPIF

SEQ ID NO: 10848 - protein, 10 aa, Homo Sapiens
IFTDTVVFRV

SEQ ID NO: 10849 - protein, 10 aa, Homo Sapiens
NTCFVDAVAE

SEQ ID NO: 10850 - protein, 10 aa, Homo Sapiens
FVDAVAELAR

SEQ ID NO: 10851 - protein, 10 aa, Homo Sapiens
EMELGYVQAP

SEQ ID NO: 10852 - protein, 10 aa, Homo Sapiens
APHKTLPVVF

SEQ ID NO: 10853 - protein, 10 aa, Homo Sapiens
RNGELQDFPY

SEQ ID NO: 10854 - protein, 10 aa, Homo Sapiens
PYKRILGPDF

SEQ ID NO: 10855 - protein, 10 aa, Homo Sapiens
DFGYVTREPR

SEQ ID NO: 10856 - protein, 10 aa, Homo Sapiens
DSFGNLEVSP

SEQ ID NO: 10857 - protein, 10 aa, Homo Sapiens
NLPGSSGRRV

SEQ ID NO: 10858 - protein, 10 aa, Homo Sapiens
KVQPPVELFV

SEQ ID NO: 10859 - protein, 10 aa, Homo Sapiens
SINQVLSNKD

SEQ ID NO: 10860 - protein, 10 aa, Homo Sapiens
FVQSCIDWNR

SEQ ID NO: 10861 - protein, 10 aa, Homo Sapiens
CIDWNREVLK

SEQ ID NO: 10862 - protein, 10 aa, Homo Sapiens
QLFKTERKKA

SEQ ID NO: 10863 - protein, 10 aa, Homo Sapiens
TERKKATAFF

SEQ ID NO: 10864 - protein, 10 aa, Homo Sapiens
PIINGCCCLE

SEQ ID NO: 10865 - protein, 10 aa, Homo Sapiens
EEKVRSLLEP

SEQ ID NO: 10866 - protein, 10 aa, Homo Sapiens
KVRSLLEPLG

SEQ ID NO: 10867 - protein, 10 aa, Homo Sapiens
KPFSFKWWNM

SEQ ID NO: 10868 - protein, 10 aa, Homo Sapiens
RVSLEHPTSA

SEQ ID NO: 10869 - protein, 10 aa, Homo Sapiens
EHPTSAVCVA

SEQ ID NO: 10870 - protein, 10 aa, Homo Sapiens
QISYHSSHEP

SEQ ID NO: 10871 - protein, 10 aa, Homo Sapiens
AVLYLTCVDI

SEQ ID NO: 10872 - protein, 10 aa, Homo Sapiens
GILLVNCDRD

SEQ ID NO: 10873 - protein, 10 aa, Homo Sapiens
HVHCLQDLED

SEQ ID NO: 10874 - protein, 10 aa, Homo Sapiens
CLQDLEDMSV

SEQ ID NO: 10875 - protein, 10 aa, Homo Sapiens
DDHKLVLHTS

SEQ ID NO: 10876 - protein, 10 aa, Homo Sapiens
EDVCEAYRHV

SEQ ID NO: 10877 - protein, 10 aa, Homo Sapiens
EAYRHVLGQD

SEQ ID NO: 10878 - protein, 10 aa, Homo Sapiens
PRLHGDEERF

SEQ ID NO: 10879 - protein, 10 aa, Homo Sapiens
VTLLDDSNED

SEQ ID NO: 10880 - protein, 10 aa, Homo Sapiens
TVVFRVAPWI

SEQ ID NO: 10881 - protein, 10 aa, Homo Sapiens
PVVFDSPRNG

SEQ ID NO: 10882 - protein, 10 aa, Homo Sapiens
YVTREPRDRS

SEQ ID NO: 10883 - protein, 10 aa, Homo Sapiens
GLDSFGNLEV

SEQ ID NO: 10884 - protein, 10 aa, Homo Sapiens
SFGNLEVSPP

SEQ ID NO: 10885 - protein, 10 aa, Homo Sapiens
PPVVANGKEY

SEQ ID NO: 10886 - protein, 10 aa, Homo Sapiens
EYPLGRILIG

SEQ ID NO: 10887 - protein, 10 aa, Homo Sapiens
AQKVQPPVEL

SEQ ID NO: 10888 - protein, 10 aa, Homo Sapiens
PAPDGKGFRM

SEQ ID NO: 10889 - protein, 10 aa, Homo Sapiens
LASPGACFKL

SEQ ID NO: 10890 - protein, 10 aa, Homo Sapiens
KLFQEKQKCG

SEQ ID NO: 10891 - protein, 10 aa, Homo Sapiens
QKCGHGRALL

SEQ ID NO: 10892 - protein, 10 aa, Homo Sapiens
DEQVKTISIN

SEQ ID NO: 10893 - protein, 10 aa, Homo Sapiens
QVLSNKDLIN

SEQ ID NO: 10894 - protein, 10 aa, Homo Sapiens
KFVQSCIDWN

SEQ ID NO: 10895 - protein, 10 aa, Homo Sapiens
SCIDWNREVL

SEQ ID NO: 10896 - protein, 10 aa, Homo Sapiens
DWNREVLKRE

SEQ ID NO: 10897 - protein, 10 aa, Homo Sapiens
WNREVLKREL

SEQ ID NO: 10898 - protein, 10 aa, Homo Sapiens
ATAFFPDLVN

SEQ ID NO: 10899 - protein, 10 aa, Homo Sapiens
SLLEPLGLHC

SEQ ID NO: 10900 - protein, 10 aa, Homo Sapiens
LEPLGLHCTF

SEQ ID NO: 10901 - protein, 10 aa, Homo Sapiens
MLHGEVHCGT

SEQ ID NO: 10902 - protein, 10 aa, Homo Sapiens
GTNVCRKPFS

SEQ ID NO: 10903 - protein, 10 aa, Homo Sapiens
TNVCRKPFSF

SEQ ID NO: 10904 - protein, 10 aa, Homo Sapiens
IVRVSLEHPT

SEQ ID NO: 10905 - protein, 10 aa, Homo Sapiens
GVETLVDIYG

SEQ ID NO: 10906 - protein, 10 aa, Homo Sapiens
TLVDIYGSVP

SEQ ID NO: 10907 - protein, 10 aa, Homo Sapiens
EMFEVYGTPG

SEQ ID NO: 10908 - protein, 10 aa, Homo Sapiens
LTCVDISLDC

SEQ ID NO: 10909 - protein, 10 aa, Homo Sapiens
SLDCDLNCEG

SEQ ID NO: 10910 - protein, 10 aa, Homo Sapiens
WGPSGYGGIL

SEQ ID NO: 10911 - protein, 10 aa, Homo Sapiens
GPSGYGGILL

SEQ ID NO: 10912 - protein, 10 aa, Homo Sapiens
LVNCDRDDPS

SEQ ID NO: 10913 - protein, 10 aa, Homo Sapiens
DMSVMVLRTQ

SEQ ID NO: 10914 - protein, 10 aa, Homo Sapiens
PAALFDDHKL

SEQ ID NO: 10915 - protein, 10 aa, Homo Sapiens
LVLHTSSYDA

SEQ ID NO: 10916 - protein, 10 aa, Homo Sapiens
KVSYEVPRLH

SEQ ID NO: 10917 - protein, 10 aa, Homo Sapiens
LISFHVTLLD

SEQ ID NO: 10918 - protein, 10 aa, Homo Sapiens
SFHVTLLDDS

SEQ ID NO: 10919 - protein, 10 aa, Homo Sapiens
LLDDSNEDFS

SEQ ID NO: 10920 - protein, 10 aa, Homo Sapiens
DSNEDFSASP

SEQ ID NO: 10921 - protein, 10 aa, Homo Sapiens
WIMTPSTLPP

SEQ ID NO: 10922 - protein, 10 aa, Homo Sapiens
YVCRVRNNTC

SEQ ID NO: 10923 - protein, 10 aa, Homo Sapiens
VCRVRNNTCF

SEQ ID NO: 10924 - protein, 10 aa, Homo Sapiens
RVRNNTCFVD

SEQ ID NO: 10925 - protein, 10 aa, Homo Sapiens
KLTICPQAEN

SEQ ID NO: 10926 - protein, 10 aa, Homo Sapiens
RNDRWIQDEM

SEQ ID NO: 10927 - protein, 10 aa, Homo Sapiens
YVQAPHKTLP

SEQ ID NO: 10928 - protein, 10 aa, Homo Sapiens
TLPVVFDSPR

SEQ ID NO: 10929 - protein, 10 aa, Homo Sapiens
ILGPDFGYVT

SEQ ID NO: 10930 - protein, 10 aa, Homo Sapiens
PVVANGKEYP

SEQ ID NO: 10931 - protein, 10 aa, Homo Sapiens
RILIGGNLPG

SEQ ID NO: 10932 - protein, 10 aa, Homo Sapiens
VTQVVRDFLH

SEQ ID NO: 10933 - protein, 10 aa, Homo Sapiens
PVELFVDWLA

SEQ ID NO: 10934 - protein, 10 aa, Homo Sapiens
LAVGHVDEFL

SEQ ID NO: 10935 - protein, 10 aa, Homo Sapiens
AVGHVDEFLS

SEQ ID NO: 10936 - protein, 10 aa, Homo Sapiens
PDGKGFRMLL

SEQ ID NO: 10937 - protein, 10 aa, Homo Sapiens
LLASPGACFK

SEQ ID NO: 10938 - protein, 10 aa, Homo Sapiens
KQKCGHGRAL

SEQ ID NO: 10939 - protein, 10 aa, Homo Sapiens
KCGHGRALLF

SEQ ID NO: 10940 - protein, 10 aa, Homo Sapiens
VLKRELGLAE

SEQ ID NO: 10941 - protein, 10 aa, Homo Sapiens
GKHLGIPKPF

SEQ ID NO: 10942 - protein, 10 aa, Homo Sapiens
GPIINGCCCL

SEQ ID NO: 10943 - protein, 10 aa, Homo Sapiens
TFIDDFTPYH

SEQ ID NO: 10944 - protein, 10 aa, Homo Sapiens
CGTNVCRKPF

SEQ ID NO: 10945 - protein, 10 aa, Homo Sapiens
SLEHPTSAVC

SEQ ID NO: 10946 - protein, 10 aa, Homo Sapiens
YGSVPEGTEM

SEQ ID NO: 10947 - protein, 10 aa, Homo Sapiens
EGTEMFEVYG

SEQ ID NO: 10948 - protein, 10 aa, Homo Sapiens
TRRWRFDATL

SEQ ID NO: 10949 - protein, 10 aa, Homo Sapiens
YHSSHEPLPL

SEQ ID NO: 10950 - protein, 10 aa, Homo Sapiens
LYLTCVDISL

SEQ ID NO: 10951 - protein, 10 aa, Homo Sapiens
KLVLHTSSYD

SEQ ID NO: 10952 - protein, 10 aa, Homo Sapiens
GFTGLISFHV

SEQ ID NO: 10953 - protein, 10 aa, Homo Sapiens
TGLISFHVTL

SEQ ID NO: 10954 - protein, 10 aa, Homo Sapiens
EDFSASPIFT

SEQ ID NO: 10955 - protein, 10 aa, Homo Sapiens
APWIMTPSTL

SEQ ID NO: 10956 - protein, 10 aa, Homo Sapiens
GYVQAPHKTL

SEQ ID NO: 10957 - protein, 10 aa, Homo Sapiens
LQDFPYKRIL

SEQ ID NO: 10958 - protein, 10 aa, Homo Sapiens
NLEVSPPVVA

SEQ ID NO: 10959 - protein, 10 aa, Homo Sapiens
LGRILIGGNL

SEQ ID NO: 10960 - protein, 10 aa, Homo Sapiens
LFVDWLAVGH

SEQ ID NO: 10961 - protein, 10 aa, Homo Sapiens
FLSFVPAPDG

SEQ ID NO: 10962 - protein, 10 aa, Homo Sapiens
SFVPAPDGKG

SEQ ID NO: 10963 - protein, 10 aa, Homo Sapiens
LFQEKQKCGH

SEQ ID NO: 10964 - protein, 10 aa, Homo Sapiens
LFQGVVDDEQ

SEQ ID NO: 10965 - protein, 10 aa, Homo Sapiens
VKTISINQVL

SEQ ID NO: 10966 - protein, 10 aa, Homo Sapiens
REVLKRELGL

SEQ ID NO: 10967 - protein, 10 aa, Homo Sapiens
FFPDLVNMLV

SEQ ID NO: 10968 - protein, 10 aa, Homo Sapiens
VNMLVLGKHL

SEQ ID NO: 10969 - protein, 10 aa, Homo Sapiens
MLVLGKHLGI

SEQ ID NO: 10970 - protein, 10 aa, Homo Sapiens
VLGKHLGIPK

SEQ ID NO: 10971 - protein, 10 aa, Homo Sapiens
HLGIPKPFGP

SEQ ID NO: 10972 - protein, 10 aa, Homo Sapiens
KPFGPIINGC

SEQ ID NO: 10973 - protein, 10 aa, Homo Sapiens
VRSLLEPLGL

SEQ ID NO: 10974 - protein, 10 aa, Homo Sapiens
DDFTPYHMLH

SEQ ID NO: 10975 - protein, 10 aa, Homo Sapiens
VDIYGSVPEG

SEQ ID NO: 10976 - protein, 10 aa, Homo Sapiens
MFEVYGTPGV

SEQ ID NO: 10977 - protein, 10 aa, Homo Sapiens
IYISPNMERG

SEQ ID NO: 10978 - protein, 10 aa, Homo Sapiens
ISYHSSHEPL

SEQ ID NO: 10979 - protein, 10 aa, Homo Sapiens
DCDLNCEGRQ

SEQ ID NO: 10980 - protein, 10 aa, Homo Sapiens
GYGGILLVNC

SEQ ID NO: 10981 - protein, 10 aa, Homo Sapiens
ILLVNCDRDD

SEQ ID NO: 10982 - protein, 10 aa, Homo Sapiens
LLVNCDRDDP

SEQ ID NO: 10983 - protein, 10 aa, Homo Sapiens
DRDDPSCDVQ

SEQ ID NO: 10984 - protein, 10 aa, Homo Sapiens
DHKLVLHTSS

SEQ ID NO: 10985 - protein, 10 aa, Homo Sapiens
GDEERFFVEG

SEQ ID NO: 10986 - protein, 10 aa, Homo Sapiens
FFVEGLSFPD

SEQ ID NO: 10987 - protein, 10 aa, Homo Sapiens
GLSFPDAGFT

SEQ ID NO: 10988 - protein, 10 aa, Homo Sapiens
PLEVYVCRVR

SEQ ID NO: 10989 - protein, 10 aa, Homo Sapiens
DSPRNGELQD

SEQ ID NO: 10990 - protein, 10 aa, Homo Sapiens
NGKEYPLGRI

SEQ ID NO: 10991 - protein, 10 aa, Homo Sapiens
GKEYPLGRIL

SEQ ID NO: 10992 - protein, 10 aa, Homo Sapiens
KGFRMLLASP

SEQ ID NO: 10993 - protein, 10 aa, Homo Sapiens
CFKLFQEKQK

SEQ ID NO: 10994 - protein, 10 aa, Homo Sapiens
EKQKCGHGRA

SEQ ID NO: 10995 - protein, 10 aa, Homo Sapiens
DDEQVKTISI

SEQ ID NO: 10996 - protein, 10 aa, Homo Sapiens
EQVKTISINQ

SEQ ID NO: 10997 - protein, 10 aa, Homo Sapiens
ISINQVLSNK

SEQ ID NO: 10998 - protein, 10 aa, Homo Sapiens
INQVLSNKDL

SEQ ID NO: 10999 - protein, 10 aa, Homo Sapiens
LKRELGLAEC

SEQ ID NO: 11000 - protein, 10 aa, Homo Sapiens
IDIPQLFKTE

SEQ ID NO: 11001 - protein, 10 aa, Homo Sapiens
LFKTERKKAT

SEQ ID NO: 11002 - protein, 10 aa, Homo Sapiens
ERKKATAFFP

SEQ ID NO: 11003 - protein, 10 aa, Homo Sapiens
LGIPKPFGPI

SEQ ID NO: 11004 - protein, 10 aa, Homo Sapiens
PFGPIINGCC

SEQ ID NO: 11005 - protein, 10 aa, Homo Sapiens
EPLGLHCTFI

SEQ ID NO: 11006 - protein, 10 aa, Homo Sapiens
PLGLHCTFID

SEQ ID NO: 11007 - protein, 10 aa, Homo Sapiens
VPEGTEMFEV

SEQ ID NO: 11008 - protein, 10 aa, Homo Sapiens
WRFDATLEII

SEQ ID NO: 11009 - protein, 10 aa, Homo Sapiens
RFDATLEIIV

SEQ ID NO: 11010 - protein, 10 aa, Homo Sapiens
LEIIVVMNSP

SEQ ID NO: 11011 - protein, 10 aa, Homo Sapiens
DSHVQISYHS

SEQ ID NO: 11012 - protein, 10 aa, Homo Sapiens
SHEPLPLAYA

SEQ ID NO: 11013 - protein, 10 aa, Homo Sapiens
EGRQDRNFVD

SEQ ID NO: 11014 - protein, 10 aa, Homo Sapiens
DRNFVDKRQW

SEQ ID NO: 11015 - protein, 10 aa, Homo Sapiens
NFVDKRQWVW

SEQ ID NO: 11016 - protein, 10 aa, Homo Sapiens
DKRQWVWGPS

SEQ ID NO: 11017 - protein, 10 aa, Homo Sapiens
VWGPSGYGGI

SEQ ID NO: 11018 - protein, 10 aa, Homo Sapiens
DPSCDVQDNC

SEQ ID NO: 11019 - protein, 10 aa, Homo Sapiens
ICGPEDVCEA

SEQ ID NO: 11020 - protein, 10 aa, Homo Sapiens
HGDEERFFVE

SEQ ID NO: 11021 - protein, 10 aa, Homo Sapiens
AGFTGLISFH

SEQ ID NO: 11022 - protein, 10 aa, Homo Sapiens
VFRVAPWIMT

SEQ ID NO: 11023 - protein, 10 aa, Homo Sapiens
PPLEVYVCRV

SEQ ID NO: 11024 - protein, 10 aa, Homo Sapiens
CFVDAVAELA

SEQ ID NO: 11025 - protein, 10 aa, Homo Sapiens
VDAVAELARK

SEQ ID NO: 11026 - protein, 10 aa, Homo Sapiens
DAVAELARKA

SEQ ID NO: 11027 - protein, 10 aa, Homo Sapiens
RKAGCKLTIC

SEQ ID NO: 11028 - protein, 10 aa, Homo Sapiens
ENRNDRWIQD

SEQ ID NO: 11029 - protein, 10 aa, Homo Sapiens
RWIQDEMELG

SEQ ID NO: 11030 - protein, 10 aa, Homo Sapiens
IQDEMELGYV

SEQ ID NO: 11031 - protein, 10 aa, Homo Sapiens
LGPDFGYVTR

SEQ ID NO: 11032 - protein, 10 aa, Homo Sapiens
LEVSPPVVAN

SEQ ID NO: 11033 - protein, 10 aa, Homo Sapiens
VANGKEYPLG

SEQ ID NO: 11034 - protein, 10 aa, Homo Sapiens
YPLGRILIGG

SEQ ID NO: 11035 - protein, 10 aa, Homo Sapiens
GSSGRRVTQV

SEQ ID NO: 11036 - protein, 10 aa, Homo Sapiens
VQPPVELFVD

SEQ ID NO: 11037 - protein, 10 aa, Homo Sapiens
DWLAVGHVDE

SEQ ID NO: 11038 - protein, 10 aa, Homo Sapiens
GFRMLLASPG

SEQ ID NO: 11039 - protein, 10 aa, Homo Sapiens
LGKHLGIPKP

SEQ ID NO: 11040 - protein, 10 aa, Homo Sapiens
VHCGTNVCRK

SEQ ID NO: 11041 - protein, 10 aa, Homo Sapiens
CRKPFSFKWW

SEQ ID NO: 11042 - protein, 10 aa, Homo Sapiens
PFSFKWWNMV

SEQ ID NO: 11043 - protein, 10 aa, Homo Sapiens
PGVDIYISPN

SEQ ID NO: 11044 - protein, 10 aa, Homo Sapiens
ERGRERADTR

SEQ ID NO: 11045 - protein, 10 aa, Homo Sapiens
NSPSNDLNDS

SEQ ID NO: 11046 - protein, 10 aa, Homo Sapiens
SHVQISYHSS

SEQ ID NO: 11047 - protein, 10 aa, Homo Sapiens
GRQDRNFVDK

SEQ ID NO: 11048 - protein, 10 aa, Homo Sapiens
RQDRNFVDKR

SEQ ID NO: 11049 - protein, 10 aa, Homo Sapiens
VDKRQWVWGP

SEQ ID NO: 11050 - protein, 10 aa, Homo Sapiens
SGYGGILLVN

SEQ ID NO: 11051 - protein, 10 aa, Homo Sapiens
LEDMSVMVLR

SEQ ID NO: 11052 - protein, 10 aa, Homo Sapiens
TQGPAALFDD

SEQ ID NO: 11053 - protein, 10 aa, Homo Sapiens
FDDHKLVLHT

SEQ ID NO: 11054 - protein, 10 aa, Homo Sapiens
VFHICGPEDV

SEQ ID NO: 11055 - protein, 10 aa, Homo Sapiens
CEAYRHVLGQ

SEQ ID NO: 11056 - protein, 10 aa, Homo Sapiens
GQDKVSYEVP

SEQ ID NO: 11057 - protein, 10 aa, Homo Sapiens
EERFFVEGLS

SEQ ID NO: 11058 - protein, 10 aa, Homo Sapiens
ISFHVTLLDD

SEQ ID NO: 11059 - protein, 10 aa, Homo Sapiens
FSASPIFTDT

SEQ ID NO: 11060 - protein, 10 aa, Homo Sapiens
LPPLEVYVCR

SEQ ID NO: 11061 - protein, 10 aa, Homo Sapiens
NRNDRWIQDE

SEQ ID NO: 11062 - protein, 10 aa, Homo Sapiens
QAPHKTLPVV

SEQ ID NO: 11063 - protein, 10 aa, Homo Sapiens
PHKTLPVVFD

SEQ ID NO: 11064 - protein, 10 aa, Homo Sapiens
GPDFGYVTRE

SEQ ID NO: 11065 - protein, 10 aa, Homo Sapiens
GRRVTQVVRD

SEQ ID NO: 11066 - protein, 10 aa, Homo Sapiens
QPPVELFVDW

SEQ ID NO: 11067 - protein, 10 aa, Homo Sapiens
GHVDEFLSFV

SEQ ID NO: 11068 - protein, 10 aa, Homo Sapiens
PGACFKLFQE

SEQ ID NO: 11069 - protein, 10 aa, Homo Sapiens
GACFKLFQEK

SEQ ID NO: 11070 - protein, 10 aa, Homo Sapiens
CGHGRALLFQ

SEQ ID NO: 11071 - protein, 10 aa, Homo Sapiens
HGRALLFQGV

SEQ ID NO: 11072 - protein, 10 aa, Homo Sapiens
INYNKFVQSC

SEQ ID NO: 11073 - protein, 10 aa, Homo Sapiens
PKPFGPIING

SEQ ID NO: 11074 - protein, 10 aa, Homo Sapiens
MSLQRIVRVS

SEQ ID NO: 11075 - protein, 10 aa, Homo Sapiens
LQRIVRVSLE

SEQ ID NO: 11076 - protein, 10 aa, Homo Sapiens
VAGVETLVDI

SEQ ID NO: 11077 - protein, 10 aa, Homo Sapiens
VETLVDIYGS

SEQ ID NO: 11078 - protein, 10 aa, Homo Sapiens
TPGVDIYISP

SEQ ID NO: 11079 - protein, 10 aa, Homo Sapiens
FDATLEIIVV

SEQ ID NO: 11080 - protein, 10 aa, Homo Sapiens
NDSHVQISYH

SEQ ID NO: 11081 - protein, 10 aa, Homo Sapiens
VQISYHSSHE

SEQ ID NO: 11082 - protein, 10 aa, Homo Sapiens
HSSHEPLPLA

SEQ ID NO: 11083 - protein, 10 aa, Homo Sapiens
AYAVLYLTCV

SEQ ID NO: 11084 - protein, 10 aa, Homo Sapiens
TCVDISLDCD

SEQ ID NO: 11085 - protein, 10 aa, Homo Sapiens
ISLDCDLNCE

SEQ ID NO: 11086 - protein, 10 aa, Homo Sapiens
RDDPSCDVQD

SEQ ID NO: 11087 - protein, 10 aa, Homo Sapiens
QGPAALFDDH

SEQ ID NO: 11088 - protein, 10 aa, Homo Sapiens
RAQVFHICGP

SEQ ID NO: 11089 - protein, 10 aa, Homo Sapiens
SYEVPRLHGD

SEQ ID NO: 11090 - protein, 10 aa, Homo Sapiens
FRVAPWIMTP

SEQ ID NO: 11091 - protein, 10 aa, Homo Sapiens
VRNNTCFVDA

SEQ ID NO: 11092 - protein, 10 aa, Homo Sapiens
RNNTCFVDAV

SEQ ID NO: 11093 - protein, 10 aa, Homo Sapiens
AGCKLTICPQ

SEQ ID NO: 11094 - protein, 10 aa, Homo Sapiens
NGELQDFPYK

SEQ ID NO: 11095 - protein, 10 aa, Homo Sapiens
FPYKRILGPD

SEQ ID NO: 11096 - protein, 10 aa, Homo Sapiens
PDFGYVTREP

SEQ ID NO: 11097 - protein, 10 aa, Homo Sapiens
TQVVRDFLHA

SEQ ID NO: 11098 - protein, 10 aa, Homo Sapiens
VDEFLSFVPA

SEQ ID NO: 11099 - protein, 10 aa, Homo Sapiens
GKGFRMLLAS

SEQ ID NO: 11100 - protein, 10 aa, Homo Sapiens
GHGRALLFQG

SEQ ID NO: 11101 - protein, 10 aa, Homo Sapiens
LSNKDLINYN

SEQ ID NO: 11102 - protein, 10 aa, Homo Sapiens
IDWNREVLKR

SEQ ID NO: 11103 - protein, 10 aa, Homo Sapiens
RKKATAFFPD

SEQ ID NO: 11104 - protein, 10 aa, Homo Sapiens
PDLVNMLVLG

SEQ ID NO: 11105 - protein, 10 aa, Homo Sapiens
INGCCCLEEK

SEQ ID NO: 11106 - protein, 10 aa, Homo Sapiens
VSLEHPTSAV

SEQ ID NO: 11107 - protein, 10 aa, Homo Sapiens
TEMFEVYGTP

SEQ ID NO: 11108 - protein, 10 aa, Homo Sapiens
LAYAVLYLTC

SEQ ID NO: 11109 - protein, 10 aa, Homo Sapiens
PSGYGGILLV

SEQ ID NO: 11110 - protein, 10 aa, Homo Sapiens
YGGILLVNCD

SEQ ID NO: 11111 - protein, 10 aa, Homo Sapiens
QDLEDMSVMV

SEQ ID NO: 11112 - protein, 10 aa, Homo Sapiens
AKRAQVFHIC

SEQ ID NO: 11113 - protein, 10 aa, Homo Sapiens
LSFPDAGFTG

SEQ ID NO: 11114 - protein, 10 aa, Homo Sapiens
PQAENRNDRW

SEQ ID NO: 11115 - protein, 10 aa, Homo Sapiens
HKTLPVVFDS

SEQ ID NO: 11116 - protein, 10 aa, Homo Sapiens
QDFPYKRILG

SEQ ID NO: 11117 - protein, 10 aa, Homo Sapiens
LDSFGNLEVS

SEQ ID NO: 11118 - protein, 10 aa, Homo Sapiens
VSPPVVANGK

SEQ ID NO: 11119 - protein, 10 aa, Homo Sapiens
ACFKLFQEKQ

SEQ ID NO: 11120 - protein, 10 aa, Homo Sapiens
LAECDIIDIP

SEQ ID NO: 11121 - protein, 10 aa, Homo Sapiens
RSLLEPLGLH

SEQ ID NO: 11122 - protein, 10 aa, Homo Sapiens
LGLHCTFIDD

SEQ ID NO: 11123 - protein, 10 aa, Homo Sapiens
HMLHGEVHCG

SEQ ID NO: 11124 - protein, 10 aa, Homo Sapiens
FSFKWWNMVP

SEQ ID NO: 11125 - protein, 10 aa, Homo Sapiens
QRIVRVSLEH

SEQ ID NO: 11126 - protein, 10 aa, Homo Sapiens
LEHPTSAVCV

SEQ ID NO: 11127 - protein, 10 aa, Homo Sapiens
HPTSAVCVAG

SEQ ID NO: 11128 - protein, 10 aa, Homo Sapiens
VDIYISPNME

SEQ ID NO: 11129 - protein, 10 aa, Homo Sapiens
PNMERGRERA

SEQ ID NO: 11130 - protein, 10 aa, Homo Sapiens
MERGRERADT

SEQ ID NO: 11131 - protein, 10 aa, Homo Sapiens
RGRERADTRR

SEQ ID NO: 11132 - protein, 10 aa, Homo Sapiens
MNSPSNDLND

SEQ ID NO: 11133 - protein, 10 aa, Homo Sapiens
PSNDLNDSHV

SEQ ID NO: 11134 - protein, 10 aa, Homo Sapiens
VDISLDCDLN

SEQ ID NO: 11135 - protein, 10 aa, Homo Sapiens
LNCEGRQDRN

SEQ ID NO: 11136 - protein, 10 aa, Homo Sapiens
RNFVDKRQWV

SEQ ID NO: 11137 - protein, 10 aa, Homo Sapiens
VNCDRDDPSC

SEQ ID NO: 11138 - protein, 10 aa, Homo Sapiens
LHTSSYDAKR

SEQ ID NO: 11139 - protein, 10 aa, Homo Sapiens
SSYDAKRAQV

SEQ ID NO: 11140 - protein, 10 aa, Homo Sapiens
YDAKRAQVFH

SEQ ID NO: 11141 - protein, 10 aa, Homo Sapiens
VSYEVPRLHG

SEQ ID NO: 11142 - protein, 10 aa, Homo Sapiens
PDAGFTGLIS

SEQ ID NO: 11143 - protein, 10 aa, Homo Sapiens
LDDSNEDFSA

SEQ ID NO: 11144 - protein, 10 aa, Homo Sapiens
VAPWIMTPST

SEQ ID NO: 11145 - protein, 10 aa, Homo Sapiens
GCKLTICPQA

SEQ ID NO: 11146 - protein, 10 aa, Homo Sapiens
ICPQAENRND

SEQ ID NO: 11147 - protein, 10 aa, Homo Sapiens
MELGYVQAPH

SEQ ID NO: 11148 - protein, 10 aa, Homo Sapiens
VQAPHKTLPV

SEQ ID NO: 11149 - protein, 10 aa, Homo Sapiens
TREPRDRSVS

SEQ ID NO: 11150 - protein, 10 aa, Homo Sapiens
REPRDRSVSG

SEQ ID NO: 11151 - protein, 10 aa, Homo Sapiens
GNLEVSPPVV

SEQ ID NO: 11152 - protein, 10 aa, Homo Sapiens
GNLPGSSGRR

SEQ ID NO: 11153 - protein, 10 aa, Homo Sapiens
VRDFLHAQKV

SEQ ID NO: 11154 - protein, 10 aa, Homo Sapiens
LHAQKVQPPV

SEQ ID NO: 11155 - protein, 10 aa, Homo Sapiens
LSFVPAPDGK

SEQ ID NO: 11156 - protein, 10 aa, Homo Sapiens
VPAPDGKGFR

SEQ ID NO: 11157 - protein, 10 aa, Homo Sapiens
QEKQKCGHGR

SEQ ID NO: 11158 - protein, 10 aa, Homo Sapiens
VDDEQVKTIS

SEQ ID NO: 11159 - protein, 10 aa, Homo Sapiens
SNKDLINYNK

SEQ ID NO: 11160 - protein, 10 aa, Homo Sapiens
FKTERKKATA

SEQ ID NO: 11161 - protein, 10 aa, Homo Sapiens
KHLGIPKPFG

SEQ ID NO: 11162 - protein, 10 aa, Homo Sapiens
IPKPFGPIIN

SEQ ID NO: 11163 - protein, 10 aa, Homo Sapiens
VRVSLEHPTS

SEQ ID NO: 11164 - protein, 10 aa, Homo Sapiens
SAVCVAGVET

SEQ ID NO: 11165 - protein, 10 aa, Homo Sapiens
YGTPGVDIYI

SEQ ID NO: 11166 - protein, 10 aa, Homo Sapiens
ISPNMERGRE

SEQ ID NO: 11167 - protein, 10 aa, Homo Sapiens
NDLNDSHVQI

SEQ ID NO: 11168 - protein, 10 aa, Homo Sapiens
SYHSSHEPLP

SEQ ID NO: 11169 - protein, 10 aa, Homo Sapiens
HEPLPLAYAV

SEQ ID NO: 11170 - protein, 10 aa, Homo Sapiens
LDCDLNCEGR

SEQ ID NO: 11171 - protein, 10 aa, Homo Sapiens
KRQWVWGPSG

SEQ ID NO: 11172 - protein, 10 aa, Homo Sapiens
GGILLVNCDR

SEQ ID NO: 11173 - protein, 10 aa, Homo Sapiens
NCDRDDPSCD

SEQ ID NO: 11174 - protein, 10 aa, Homo Sapiens
CDVQDNCDQH

SEQ ID NO: 11175 - protein, 10 aa, Homo Sapiens
QDNCDQHVHC

SEQ ID NO: 11176 - protein, 10 aa, Homo Sapiens
NCDQHVHCLQ

SEQ ID NO: 11177 - protein, 10 aa, Homo Sapiens
HCLQDLEDMS

SEQ ID NO: 11178 - protein, 10 aa, Homo Sapiens
GPAALFDDHK

SEQ ID NO: 11179 - protein, 10 aa, Homo Sapiens
KRAQVFHICG

SEQ ID NO: 11180 - protein, 10 aa, Homo Sapiens
FHICGPEDVC

SEQ ID NO: 11181 - protein, 10 aa, Homo Sapiens
GPEDVCEAYR

SEQ ID NO: 11182 - protein, 10 aa, Homo Sapiens
PEDVCEAYRH

SEQ ID NO: 11183 - protein, 10 aa, Homo Sapiens
LGQDKVSYEV

SEQ ID NO: 11184 - protein, 10 aa, Homo Sapiens
QDKVSYEVPR

SEQ ID NO: 11185 - protein, 10 aa, Homo Sapiens
YEVPRLHGDE

SEQ ID NO: 11186 - protein, 10 aa, Homo Sapiens
SNEDFSASPI

SEQ ID NO: 11187 - protein, 10 aa, Homo Sapiens
SASPIFTDTV

SEQ ID NO: 11188 - protein, 10 aa, Homo Sapiens
TDTVVFRVAP

SEQ ID NO: 11189 - protein, 10 aa, Homo Sapiens
PWIMTPSTLP

SEQ ID NO: 11190 - protein, 10 aa, Homo Sapiens
LEVYVCRVRN

SEQ ID NO: 11191 - protein, 10 aa, Homo Sapiens
VAELARKAGC

SEQ ID NO: 11192 - protein, 10 aa, Homo Sapiens
CKLTICPQAE

SEQ ID NO: 11193 - protein, 10 aa, Homo Sapiens
LPVVFDSPRN

SEQ ID NO: 11194 - protein, 10 aa, Homo Sapiens
FDSPRNGELQ

SEQ ID NO: 11195 - protein, 10 aa, Homo Sapiens
PRNGELQDFP

SEQ ID NO: 11196 - protein, 10 aa, Homo Sapiens
GELQDFPYKR

SEQ ID NO: 11197 - protein, 10 aa, Homo Sapiens
FGYVTREPRD

SEQ ID NO: 11198 - protein, 10 aa, Homo Sapiens
RSVSGLDSFG

SEQ ID NO: 11199 - protein, 10 aa, Homo Sapiens
SPPVVANGKE

SEQ ID NO: 11200 - protein, 10 aa, Homo Sapiens
ANGKEYPLGR

SEQ ID NO: 11201 - protein, 10 aa, Homo Sapiens
KEYPLGRILI

SEQ ID NO: 11202 - protein, 10 aa, Homo Sapiens
GRILIGGNLP

SEQ ID NO: 11203 - protein, 10 aa, Homo Sapiens
IGGNLPGSSG

SEQ ID NO: 11204 - protein, 10 aa, Homo Sapiens
GGNLPGSSGR

SEQ ID NO: 11205 - protein, 10 aa, Homo Sapiens
PGSSGRRVTQ

SEQ ID NO: 11206 - protein, 10 aa, Homo Sapiens
RDFLHAQKVQ

SEQ ID NO: 11207 - protein, 10 aa, Homo Sapiens
HAQKVQPPVE

SEQ ID NO: 11208 - protein, 10 aa, Homo Sapiens
FRMLLASPGA

SEQ ID NO: 11209 - protein, 10 aa, Homo Sapiens
FKLFQEKQKC

SEQ ID NO: 11210 - protein, 10 aa, Homo Sapiens
FQEKQKCGHG

SEQ ID NO: 11211 - protein, 10 aa, Homo Sapiens
NYNKFVQSCI

SEQ ID NO: 11212 - protein, 10 aa, Homo Sapiens
NKFVQSCIDW

SEQ ID NO: 11213 - protein, 10 aa, Homo Sapiens
RELGLAECDI

SEQ ID NO: 11214 - protein, 10 aa, Homo Sapiens
CCCLEEKVRS

SEQ ID NO: 11215 - protein, 10 aa, Homo Sapiens
YHMLHGEVHC

SEQ ID NO: 11216 - protein, 10 aa, Homo Sapiens
LHGEVHCGTN

SEQ ID NO: 11217 - protein, 10 aa, Homo Sapiens
VCRKPFSFKW

SEQ ID NO: 11218 - protein, 10 aa, Homo Sapiens
TSAVCVAGVE

SEQ ID NO: 11219 - protein, 10 aa, Homo Sapiens
IYGSVPEGTE

SEQ ID NO: 11220 - protein, 10 aa, Homo Sapiens
SPNMERGRER

SEQ ID NO: 11221 - protein, 10 aa, Homo Sapiens
NMERGRERAD

SEQ ID NO: 11222 - protein, 10 aa, Homo Sapiens
GRERADTRRW

SEQ ID NO: 11223 - protein, 10 aa, Homo Sapiens
RADTRRWRFD

SEQ ID NO: 11224 - protein, 10 aa, Homo Sapiens
RWRFDATLEI

SEQ ID NO: 11225 - protein, 10 aa, Homo Sapiens
VMNSPSNDLN

SEQ ID NO: 11226 - protein, 10 aa, Homo Sapiens
SPSNDLNDSH

SEQ ID NO: 11227 - protein, 10 aa, Homo Sapiens
SNDLNDSHVQ

SEQ ID NO: 11228 - protein, 10 aa, Homo Sapiens
CDLNCEGRQD

SEQ ID NO: 11229 - protein, 10 aa, Homo Sapiens
QDRNFVDKRQ

SEQ ID NO: 11230 - protein, 10 aa, Homo Sapiens
CDRDDPSCDV

SEQ ID NO: 11231 - protein, 10 aa, Homo Sapiens
PSCDVQDNCD

SEQ ID NO: 11232 - protein, 10 aa, Homo Sapiens
SCDVQDNCDQ

SEQ ID NO: 11233 - protein, 10 aa, Homo Sapiens
VQDNCDQHVH

SEQ ID NO: 11234 - protein, 10 aa, Homo Sapiens
CDQHVHCLQD

SEQ ID NO: 11235 - protein, 10 aa, Homo Sapiens
MSVMVLRTQG

SEQ ID NO: 11236 - protein, 10 aa, Homo Sapiens
TSSYDAKRAQ

SEQ ID NO: 11237 - protein, 10 aa, Homo Sapiens
VCEAYRHVLG

SEQ ID NO: 11238 - protein, 10 aa, Homo Sapiens
AYRHVLGQDK

SEQ ID NO: 11239 - protein, 10 aa, Homo Sapiens
YRHVLGQDKV

SEQ ID NO: 11240 - protein, 10 aa, Homo Sapiens
VPRLHGDEER

SEQ ID NO: 11241 - protein, 10 aa, Homo Sapiens
LHGDEERFFV

SEQ ID NO: 11242 - protein, 10 aa, Homo Sapiens
VEGLSFPDAG

SEQ ID NO: 11243 - protein, 10 aa, Homo Sapiens
FPDAGFTGLI

SEQ ID NO: 11244 - protein, 10 aa, Homo Sapiens
FHVTLLDDSN

SEQ ID NO: 11245 - protein, 10 aa, Homo Sapiens
ASPIFTDTVV

SEQ ID NO: 11246 - protein, 10 aa, Homo Sapiens
TPSTLPPLEV

SEQ ID NO: 11247 - protein, 10 aa, Homo Sapiens
VYVCRVRNNT

SEQ ID NO: 11248 - protein, 10 aa, Homo Sapiens
NNTCFVDAVA

SEQ ID NO: 11249 - protein, 10 aa, Homo Sapiens
LARKAGCKLT

SEQ ID NO: 11250 - protein, 10 aa, Homo Sapiens
ARKAGCKLTI

SEQ ID NO: 11251 - protein, 10 aa, Homo Sapiens
NDRWIQDEME

SEQ ID NO: 11252 - protein, 10 aa, Homo Sapiens
LGYVQAPHKT

SEQ ID NO: 11253 - protein, 10 aa, Homo Sapiens
PRDRSVSGLD

SEQ ID NO: 11254 - protein, 10 aa, Homo Sapiens
RDRSVSGLDS

SEQ ID NO: 11255 - protein, 10 aa, Homo Sapiens
SGLDSFGNLE

SEQ ID NO: 11256 - protein, 10 aa, Homo Sapiens
FGNLEVSPPV

SEQ ID NO: 11257 - protein, 10 aa, Homo Sapiens
LPGSSGRRVT

SEQ ID NO: 11258 - protein, 10 aa, Homo Sapiens
SSGRRVTQVV

SEQ ID NO: 11259 - protein, 10 aa, Homo Sapiens
SGRRVTQVVR

SEQ ID NO: 11260 - protein, 10 aa, Homo Sapiens
VELFVDWLAV

SEQ ID NO: 11261 - protein, 10 aa, Homo Sapiens
RMLLASPGAC

SEQ ID NO: 11262 - protein, 10 aa, Homo Sapiens
GRALLFQGVV

SEQ ID NO: 11263 - protein, 10 aa, Homo Sapiens
RALLFQGVVD

SEQ ID NO: 11264 - protein, 10 aa, Homo Sapiens
FQGVVDDEQV

SEQ ID NO: 11265 - protein, 10 aa, Homo Sapiens
QGVVDDEQVK

SEQ ID NO: 11266 - protein, 10 aa, Homo Sapiens
YNKFVQSCID

SEQ ID NO: 11267 - protein, 10 aa, Homo Sapiens
VQSCIDWNRE

SEQ ID NO: 11268 - protein, 10 aa, Homo Sapiens
QSCIDWNREV

SEQ ID NO: 11269 - protein, 10 aa, Homo Sapiens
AECDIIDIPQ

SEQ ID NO: 11270 - protein, 10 aa, Homo Sapiens
IPQLFKTERK

SEQ ID NO: 11271 - protein, 10 aa, Homo Sapiens
PQLFKTERKK

SEQ ID NO: 11272 - protein, 10 aa, Homo Sapiens
FGPIINGCCC

SEQ ID NO: 11273 - protein, 10 aa, Homo Sapiens
NGCCCLEEKV

SEQ ID NO: 11274 - protein, 10 aa, Homo Sapiens
LEEKVRSLLE

SEQ ID NO: 11275 - protein, 10 aa, Homo Sapiens
TPYHMLHGEV

SEQ ID NO: 11276 - protein, 10 aa, Homo Sapiens
HGEVHCGTNV

SEQ ID NO: 11277 - protein, 10 aa, Homo Sapiens
HCGTNVCRKP

SEQ ID NO: 11278 - protein, 10 aa, Homo Sapiens
RKPFSFKWWN

SEQ ID NO: 11279 - protein, 10 aa, Homo Sapiens
IMTPSTLAPL

SEQ ID NO: 11280 - protein, 10 aa, Homo Sapiens
TLAPLEVYVC

SEQ ID NO: 11281 - protein, 10 aa, Homo Sapiens
PSTLAPLEVY

SEQ ID NO: 11282 - protein, 10 aa, Homo Sapiens
MTPSTLAPLE

SEQ ID NO: 11283 - protein, 10 aa, Homo Sapiens
WIMTPSTLAP

SEQ ID NO: 11284 - protein, 10 aa, Homo Sapiens
STLAPLEVYV

SEQ ID NO: 11285 - protein, 10 aa, Homo Sapiens
APLEVYVCRV

SEQ ID NO: 11286 - protein, 10 aa, Homo Sapiens
LAPLEVYVCR

SEQ ID NO: 11287 - protein, 10 aa, Homo Sapiens
PWIMTPSTLA

SEQ ID NO: 11288 - protein, 10 aa, Homo Sapiens
TPSTLAPLEV

SEQ ID NO: 11289 - protein, 10 aa, Homo Sapiens
FVPVPDGKGF

SEQ ID NO: 11290 - protein, 10 aa, Homo Sapiens
PVPDGKGFRM

SEQ ID NO: 11291 - protein, 10 aa, Homo Sapiens
VPDGKGFRML

SEQ ID NO: 11292 - protein, 10 aa, Homo Sapiens
EFLSFVPVPD

SEQ ID NO: 11293 - protein, 10 aa, Homo Sapiens
DEFLSFVPVP

SEQ ID NO: 11294 - protein, 10 aa, Homo Sapiens
FLSFVPVPDG

SEQ ID NO: 11295 - protein, 10 aa, Homo Sapiens
SFVPVPDGKG

SEQ ID NO: 11296 - protein, 10 aa, Homo Sapiens
VDEFLSFVPV

SEQ ID NO: 11297 - protein, 10 aa, Homo Sapiens
LSFVPVPDGK

SEQ ID NO: 11298 - protein, 10 aa, Homo Sapiens
VPVPDGKGFR

SEQ ID NO: 11299 - protein, 10 aa, Homo Sapiens
APDGKGFRML

SEQ ID NO: 11300 - protein, 10 aa, Homo Sapiens
EPLPLAYAVL

SEQ ID NO: 11301 - protein, 10 aa, Homo Sapiens
LPLAYAVLYL

SEQ ID NO: 11302 - protein, 10 aa, Homo Sapiens
GPSGYGGILL

SEQ ID NO: 11303 - protein, 10 aa, Homo Sapiens
EPRDRSVSGL

SEQ ID NO: 11304 - protein, 10 aa, Homo Sapiens
FPDLVNMLVL

SEQ ID NO: 11305 - protein, 10 aa, Homo Sapiens
APWIMTPSTL

SEQ ID NO: 11306 - protein, 10 aa, Homo Sapiens
APHKTLPVVF

SEQ ID NO: 11307 - protein, 10 aa, Homo Sapiens
PPVELFVDWL

SEQ ID NO: 11308 - protein, 10 aa, Homo Sapiens
EPLGLHCTFI

SEQ ID NO: 11309 - protein, 10 aa, Homo Sapiens
SPIFTDTVVF

SEQ ID NO: 11310 - protein, 10 aa, Homo Sapiens
TPSTLPPLEV

SEQ ID NO: 11311 - protein, 10 aa, Homo Sapiens
GPIINGCCCL

SEQ ID NO: 11312 - protein, 10 aa, Homo Sapiens
FPDAGFTGLI

SEQ ID NO: 11313 - protein, 10 aa, Homo Sapiens
LPGSSGRRVT

SEQ ID NO: 11314 - protein, 10 aa, Homo Sapiens
VPEGTEMFEV

SEQ ID NO: 11315 - protein, 10 aa, Homo Sapiens
SPRNGELQDF

SEQ ID NO: 11316 - protein, 10 aa, Homo Sapiens
PPLEVYVCRV

SEQ ID NO: 11317 - protein, 10 aa, Homo Sapiens
KPFSFKWWNM

SEQ ID NO: 11318 - protein, 10 aa, Homo Sapiens
TPYHMLHGEV

SEQ ID NO: 11319 - protein, 10 aa, Homo Sapiens
YHSSHEPLPL

SEQ ID NO: 11320 - protein, 10 aa, Homo Sapiens
ALFDDHKLVL

SEQ ID NO: 11321 - protein, 10 aa, Homo Sapiens
SPGACFKLFQ

SEQ ID NO: 11322 - protein, 10 aa, Homo Sapiens
VLRTQGPAAL

SEQ ID NO: 11323 - protein, 10 aa, Homo Sapiens
IMTPSTLPPL

SEQ ID NO: 11324 - protein, 10 aa, Homo Sapiens
AQKVQPPVEL

SEQ ID NO: 11325 - protein, 10 aa, Homo Sapiens
QKCGHGRALL

SEQ ID NO: 11326 - protein, 10 aa, Homo Sapiens
KKATAFFPDL

SEQ ID NO: 11327 - protein, 10 aa, Homo Sapiens
AFFPDLVNML

SEQ ID NO: 11328 - protein, 10 aa, Homo Sapiens
VRSLLEPLGL

SEQ ID NO: 11329 - protein, 10 aa, Homo Sapiens
SLQRIVRVSL

SEQ ID NO: 11330 - protein, 10 aa, Homo Sapiens
HPTSAVCVAG

SEQ ID NO: 11331 - protein, 10 aa, Homo Sapiens
AVCVAGVETL

SEQ ID NO: 11332 - protein, 10 aa, Homo Sapiens
TRRWRFDATL

SEQ ID NO: 11333 - protein, 10 aa, Homo Sapiens
GPDFGYVTRE

SEQ ID NO: 11334 - protein, 10 aa, Homo Sapiens
RVTQVVRDFL

SEQ ID NO: 11335 - protein, 10 aa, Homo Sapiens
QPPVELFVDW

SEQ ID NO: 11336 - protein, 10 aa, Homo Sapiens
LAVGHVDEFL

SEQ ID NO: 11337 - protein, 10 aa, Homo Sapiens
VPAPDGKGFR

SEQ ID NO: 11338 - protein, 10 aa, Homo Sapiens
PDGKGFRMLL

SEQ ID NO: 11339 - protein, 10 aa, Homo Sapiens
LASPGACFKL

SEQ ID NO: 11340 - protein, 10 aa, Homo Sapiens
REVLKRELGL

SEQ ID NO: 11341 - protein, 10 aa, Homo Sapiens
ECDIIDIPQL

SEQ ID NO: 11342 - protein, 10 aa, Homo Sapiens
KPFGPIINGC

SEQ ID NO: 11343 - protein, 10 aa, Homo Sapiens
MERGRERADT

SEQ ID NO: 11344 - protein, 10 aa, Homo Sapiens
RWRFDATLEI

SEQ ID NO: 11345 - protein, 10 aa, Homo Sapiens
SPSNDLNDSH

SEQ ID NO: 11346 - protein, 10 aa, Homo Sapiens
ISYHSSHEPL

SEQ ID NO: 11347 - protein, 10 aa, Homo Sapiens
DPSCDVQDNC

SEQ ID NO: 11348 - protein, 10 aa, Homo Sapiens
DLEDMSVMVL

SEQ ID NO: 11349 - protein, 10 aa, Homo Sapiens
GPAALFDDHK

SEQ ID NO: 11350 - protein, 10 aa, Homo Sapiens
DVCEAYRHVL

SEQ ID NO: 11351 - protein, 10 aa, Homo Sapiens
DKVSYEVPRL

SEQ ID NO: 11352 - protein, 10 aa, Homo Sapiens
VPRLHGDEER

SEQ ID NO: 11353 - protein, 10 aa, Homo Sapiens
SFPDAGFTGL

SEQ ID NO: 11354 - protein, 10 aa, Homo Sapiens
TGLISFHVTL

SEQ ID NO: 11355 - protein, 10 aa, Homo Sapiens
GLISFHVTLL

SEQ ID NO: 11356 - protein, 10 aa, Homo Sapiens
LPPLEVYVCR

SEQ ID NO: 11357 - protein, 10 aa, Homo Sapiens
TCFVDAVAEL

SEQ ID NO: 11358 - protein, 10 aa, Homo Sapiens
ELARKAGCKL

SEQ ID NO: 11359 - protein, 10 aa, Homo Sapiens
CPQAENRNDR

SEQ ID NO: 11360 - protein, 10 aa, Homo Sapiens
VQAPHKTLPV

SEQ ID NO: 11361 - protein, 10 aa, Homo Sapiens
FPYKRILGPD

SEQ ID NO: 11362 - protein, 10 aa, Homo Sapiens
VSGLDSFGNL

SEQ ID NO: 11363 - protein, 10 aa, Homo Sapiens
VVANGKEYPL

SEQ ID NO: 11364 - protein, 10 aa, Homo Sapiens
YPLGRILIGG

SEQ ID NO: 11365 - protein, 10 aa, Homo Sapiens
LGRILIGGNL

SEQ ID NO: 11366 - protein, 10 aa, Homo Sapiens
GSSGRRVTQV

SEQ ID NO: 11367 - protein, 10 aa, Homo Sapiens
KQKCGHGRAL

SEQ ID NO: 11368 - protein, 10 aa, Homo Sapiens
SCIDWNREVL

SEQ ID NO: 11369 - protein, 10 aa, Homo Sapiens
WNREVLKREL

SEQ ID NO: 11370 - protein, 10 aa, Homo Sapiens
IPQLFKTERK

SEQ ID NO: 11371 - protein, 10 aa, Homo Sapiens
TERKKATAFF

SEQ ID NO: 11372 - protein, 10 aa, Homo Sapiens
IPKPFGPIIN

SEQ ID NO: 11373 - protein, 10 aa, Homo Sapiens
EKVRSLLEPL

SEQ ID NO: 11374 - protein, 10 aa, Homo Sapiens
IDDFTPYHML

SEQ ID NO: 11375 - protein, 10 aa, Homo Sapiens
PTSAVCVAGV

SEQ ID NO: 11376 - protein, 10 aa, Homo Sapiens
EVYGTPGVDI

SEQ ID NO: 11377 - protein, 10 aa, Homo Sapiens
TPGVDIYISP

SEQ ID NO: 11378 - protein, 10 aa, Homo Sapiens
VVMNSPSNDL

SEQ ID NO: 11379 - protein, 10 aa, Homo Sapiens
CVDISLDCDL

SEQ ID NO: 11380 - protein, 10 aa, Homo Sapiens
DNCDQHVHCL

SEQ ID NO: 11381 - protein, 10 aa, Homo Sapiens
EDMSVMVLRT

SEQ ID NO: 11382 - protein, 10 aa, Homo Sapiens
PAALFDDHKL

SEQ ID NO: 11383 - protein, 10 aa, Homo Sapiens
GPEDVCEAYR

SEQ ID NO: 11384 - protein, 10 aa, Homo Sapiens
DEERFFVEGL

SEQ ID NO: 11385 - protein, 10 aa, Homo Sapiens
ARKAGCKLTI

SEQ ID NO: 11386 - protein, 10 aa, Homo Sapiens
LPVVFDSPRN

SEQ ID NO: 11387 - protein, 10 aa, Homo Sapiens
VFDSPRNGEL

SEQ ID NO: 11388 - protein, 10 aa, Homo Sapiens
LQDFPYKRIL

SEQ ID NO: 11389 - protein, 10 aa, Homo Sapiens
KVQPPVELFV

SEQ ID NO: 11390 - protein, 10 aa, Homo Sapiens
ASPGACFKLF

SEQ ID NO: 11391 - protein, 10 aa, Homo Sapiens
VKTISINQVL

SEQ ID NO: 11392 - protein, 10 aa, Homo Sapiens
INQVLSNKDL

SEQ ID NO: 11393 - protein, 10 aa, Homo Sapiens
VNMLVLGKHL

SEQ ID NO: 11394 - protein, 10 aa, Homo Sapiens
CCLEEKVRSL

SEQ ID NO: 11395 - protein, 10 aa, Homo Sapiens
CLEEKVRSLL

SEQ ID NO: 11396 - protein, 10 aa, Homo Sapiens
IVRVSLEHPT

SEQ ID NO: 11397 - protein, 10 aa, Homo Sapiens
RVSLEHPTSA

SEQ ID NO: 11398 - protein, 10 aa, Homo Sapiens
SPNMERGRER

SEQ ID NO: 11399 - protein, 10 aa, Homo Sapiens
DTRRWRFDAT

SEQ ID NO: 11400 - protein, 10 aa, Homo Sapiens
AYAVLYLTCV

SEQ ID NO: 11401 - protein, 10 aa, Homo Sapiens
AVLYLTCVDI

SEQ ID NO: 11402 - protein, 10 aa, Homo Sapiens
LYLTCVDISL

SEQ ID NO: 11403 - protein, 10 aa, Homo Sapiens
WGPSGYGGIL

SEQ ID NO: 11404 - protein, 10 aa, Homo Sapiens
DQHVHCLQDL

SEQ ID NO: 11405 - protein, 10 aa, Homo Sapiens
FDDHKLVLHT

SEQ ID NO: 11406 - protein, 10 aa, Homo Sapiens
ICGPEDVCEA

SEQ ID NO: 11407 - protein, 10 aa, Homo Sapiens
RLHGDEERFF

SEQ ID NO: 11408 - protein, 10 aa, Homo Sapiens
FVEGLSFPDA

SEQ ID NO: 11409 - protein, 10 aa, Homo Sapiens
SASPIFTDTV

SEQ ID NO: 11410 - protein, 10 aa, Homo Sapiens
ASPIFTDTVV

SEQ ID NO: 11411 - protein, 10 aa, Homo Sapiens
DRWIQDEMEL

SEQ ID NO: 11412 - protein, 10 aa, Homo Sapiens
GYVQAPHKTL

SEQ ID NO: 11413 - protein, 10 aa, Homo Sapiens
RILGPDFGYV

SEQ ID NO: 11414 - protein, 10 aa, Homo Sapiens
ILGPDFGYVT

SEQ ID NO: 11415 - protein, 10 aa, Homo Sapiens
SPPVVANGKE

SEQ ID NO: 11416 - protein, 10 aa, Homo Sapiens
PPVVANGKEY

SEQ ID NO: 11417 - protein, 10 aa, Homo Sapiens
GKEYPLGRIL

SEQ ID NO: 11418 - protein, 10 aa, Homo Sapiens
VDEFLSFVPA

SEQ ID NO: 11419 - protein, 10 aa, Homo Sapiens
DGKGFRMLLA

SEQ ID NO: 11420 - protein, 10 aa, Homo Sapiens
KCGHGRALLF

SEQ ID NO: 11421 - protein, 10 aa, Homo Sapiens
HGRALLFQGV

SEQ ID NO: 11422 - protein, 10 aa, Homo Sapiens
LEHPTSAVCV

SEQ ID NO: 11423 - protein, 10 aa, Homo Sapiens
EHPTSAVCVA

SEQ ID NO: 11424 - protein, 10 aa, Homo Sapiens
VAGVETLVDI

SEQ ID NO: 11425 - protein, 10 aa, Homo Sapiens
YGSVPEGTEM

SEQ ID NO: 11426 - protein, 10 aa, Homo Sapiens
ERADTRRWRF

SEQ ID NO: 11427 - protein, 10 aa, Homo Sapiens
ADTRRWRFDA

SEQ ID NO: 11428 - protein, 10 aa, Homo Sapiens
RFDATLEIIV

SEQ ID NO: 11429 - protein, 10 aa, Homo Sapiens
DATLEIIVVM

SEQ ID NO: 11430 - protein, 10 aa, Homo Sapiens
HSSHEPLPLA

SEQ ID NO: 11431 - protein, 10 aa, Homo Sapiens
CEGRQDRNFV

SEQ ID NO: 11432 - protein, 10 aa, Homo Sapiens
PSGYGGILLV

SEQ ID NO: 11433 - protein, 10 aa, Homo Sapiens
SYDAKRAQVF

SEQ ID NO: 11434 - protein, 10 aa, Homo Sapiens
LHGDEERFFV

SEQ ID NO: 11435 - protein, 10 aa, Homo Sapiens
ERFFVEGLSF

SEQ ID NO: 11436 - protein, 10 aa, Homo Sapiens
GLSFPDAGFT

SEQ ID NO: 11437 - protein, 10 aa, Homo Sapiens
FTGLISFHVT

SEQ ID NO: 11438 - protein, 10 aa, Homo Sapiens
FSASPIFTDT

SEQ ID NO: 11439 - protein, 10 aa, Homo Sapiens
FTDTVVFRVA

SEQ ID NO: 11440 - protein, 10 aa, Homo Sapiens
STLPPLEVYV

SEQ ID NO: 11441 - protein, 10 aa, Homo Sapiens
VCRVRNNTCF

SEQ ID NO: 11442 - protein, 10 aa, Homo Sapiens
VRNNTCFVDA

SEQ ID NO: 11443 - protein, 10 aa, Homo Sapiens
RNNTCFVDAV

SEQ ID NO: 11444 - protein, 10 aa, Homo Sapiens
LARKAGCKLT

SEQ ID NO: 11445 - protein, 10 aa, Homo Sapiens
DEMELGYVQA

SEQ ID NO: 11446 - protein, 10 aa, Homo Sapiens
GLDSFGNLEV

SEQ ID NO: 11447 - protein, 10 aa, Homo Sapiens
NLEVSPPVVA

SEQ ID NO: 11448 - protein, 10 aa, Homo Sapiens
KEYPLGRILI

SEQ ID NO: 11449 - protein, 10 aa, Homo Sapiens
SSGRRVTQVV

SEQ ID NO: 11450 - protein, 10 aa, Homo Sapiens
TQVVRDFLHA

SEQ ID NO: 11451 - protein, 10 aa, Homo Sapiens
LHAQKVQPPV

SEQ ID NO: 11452 - protein, 10 aa, Homo Sapiens
VELFVDWLAV

SEQ ID NO: 11453 - protein, 10 aa, Homo Sapiens
VGHVDEFLSF

SEQ ID NO: 11454 - protein, 10 aa, Homo Sapiens
RELGLAECDI

SEQ ID NO: 11455 - protein, 10 aa, Homo Sapiens
KTERKKATAF

SEQ ID NO: 11456 - protein, 10 aa, Homo Sapiens
LGIPKPFGPI

SEQ ID NO: 11457 - protein, 10 aa, Homo Sapiens
VSLEHPTSAV

SEQ ID NO: 11458 - protein, 10 aa, Homo Sapiens
SAVCVAGVET

SEQ ID NO: 11459 - protein, 10 aa, Homo Sapiens
VCVAGVETLV

SEQ ID NO: 11460 - protein, 10 aa, Homo Sapiens
DIYGSVPEGT

SEQ ID NO: 11461 - protein, 10 aa, Homo Sapiens
GSVPEGTEMF

SEQ ID NO: 11462 - protein, 10 aa, Homo Sapiens
MFEVYGTPGV

SEQ ID NO: 11463 - protein, 10 aa, Homo Sapiens
GVDIYISPNM

SEQ ID NO: 11464 - protein, 10 aa, Homo Sapiens
PNMERGRERA

SEQ ID NO: 11465 - protein, 10 aa, Homo Sapiens
FDATLEIIVV

SEQ ID NO: 11466 - protein, 10 aa, Homo Sapiens
NDLNDSHVQI

SEQ ID NO: 11467 - protein, 10 aa, Homo Sapiens
SHEPLPLAYA

SEQ ID NO: 11468 - protein, 10 aa, Homo Sapiens
NCEGRQDRNF

SEQ ID NO: 11469 - protein, 10 aa, Homo Sapiens
RNFVDKRQWV

SEQ ID NO: 11470 - protein, 10 aa, Homo Sapiens
VWGPSGYGGI

SEQ ID NO: 11471 - protein, 10 aa, Homo Sapiens
CDRDDPSCDV

SEQ ID NO: 11472 - protein, 10 aa, Homo Sapiens
LQDLEDMSVM

SEQ ID NO: 11473 - protein, 10 aa, Homo Sapiens
QDLEDMSVMV

SEQ ID NO: 11474 - protein, 10 aa, Homo Sapiens
MVLRTQGPAA

SEQ ID NO: 11475 - protein, 10 aa, Homo Sapiens
AALFDDHKLV

SEQ ID NO: 11476 - protein, 10 aa, Homo Sapiens
HTSSYDAKRA

SEQ ID NO: 11477 - protein, 10 aa, Homo Sapiens
SSYDAKRAQV

SEQ ID NO: 11478 - protein, 10 aa, Homo Sapiens
EGLSFPDAGF

SEQ ID NO: 11479 - protein, 10 aa, Homo Sapiens
GFTGLISFHV

SEQ ID NO: 11480 - protein, 10 aa, Homo Sapiens
NEDFSASPIF

SEQ ID NO: 11481 - protein, 10 aa, Homo Sapiens
EDFSASPIFT

SEQ ID NO: 11482 - protein, 10 aa, Homo Sapiens
IFTDTVVFRV

SEQ ID NO: 11483 - protein, 10 aa, Homo Sapiens
VFRVAPWIMT

SEQ ID NO: 11484 - protein, 10 aa, Homo Sapiens
VAPWIMTPST

SEQ ID NO: 11485 - protein, 10 aa, Homo Sapiens
CRVRNNTCFV

SEQ ID NO: 11486 - protein, 10 aa, Homo Sapiens
NNTCFVDAVA

SEQ ID NO: 11487 - protein, 10 aa, Homo Sapiens
RNDRWIQDEM

SEQ ID NO: 11488 - protein, 10 aa, Homo Sapiens
IQDEMELGYV

SEQ ID NO: 11489 - protein, 10 aa, Homo Sapiens
QAPHKTLPVV

SEQ ID NO: 11490 - protein, 10 aa, Homo Sapiens
VTREPRDRSV

SEQ ID NO: 11491 - protein, 10 aa, Homo Sapiens
DRSVSGLDSF

SEQ ID NO: 11492 - protein, 10 aa, Homo Sapiens
FGNLEVSPPV

SEQ ID NO: 11493 - protein, 10 aa, Homo Sapiens
GNLEVSPPVV

SEQ ID NO: 11494 - protein, 10 aa, Homo Sapiens
NLPGSSGRRV

SEQ ID NO: 11495 - protein, 10 aa, Homo Sapiens
RRVTQVVRDF

SEQ ID NO: 11496 - protein, 10 aa, Homo Sapiens
FVDWLAVGHV

SEQ ID NO: 11497 - protein, 10 aa, Homo Sapiens
WLAVGHVDEF

SEQ ID NO: 11498 - protein, 10 aa, Homo Sapiens
FRMLLASPGA

SEQ ID NO: 11499 - protein, 10 aa, Homo Sapiens
MLLASPGACF

SEQ ID NO: 11500 - protein, 10 aa, Homo Sapiens
EKQKCGHGRA

SEQ ID NO: 11501 - protein, 10 aa, Homo Sapiens
GRALLFQGVV

SEQ ID NO: 11502 - protein, 10 aa, Homo Sapiens
GVVDDEQVKT

SEQ ID NO: 11503 - protein, 10 aa, Homo Sapiens
VVDDEQVKTI

SEQ ID NO: 11504 - protein, 10 aa, Homo Sapiens
KDLINYNKFV

SEQ ID NO: 11505 - protein, 10 aa, Homo Sapiens
EVLKRELGLA

SEQ ID NO: 11506 - protein, 10 aa, Homo Sapiens
ELGLAECDII

SEQ ID NO: 11507 - protein, 10 aa, Homo Sapiens
IIDIPQLFKT

SEQ ID NO: 11508 - protein, 10 aa, Homo Sapiens
QLFKTERKKA

SEQ ID NO: 11509 - protein, 10 aa, Homo Sapiens
KATAFFPDLV

SEQ ID NO: 11510 - protein, 10 aa, Homo Sapiens
TAFFPDLVNM

SEQ ID NO: 11511 - protein, 10 aa, Homo Sapiens
MLVLGKHLGI

SEQ ID NO: 11512 - protein, 10 aa, Homo Sapiens
GIPKPFGPII

SEQ ID NO: 11513 - protein, 10 aa, Homo Sapiens
MLHGEVHCGT

SEQ ID NO: 11514 - protein, 10 aa, Homo Sapiens
CGTNVCRKPF

SEQ ID NO: 11515 - protein, 10 aa, Homo Sapiens
PFSFKWWNMV

SEQ ID NO: 11516 - protein, 10 aa, Homo Sapiens
CVAGVETLVD

SEQ ID NO: 11517 - protein, 10 aa, Homo Sapiens
ETLVDIYGSV

SEQ ID NO: 11518 - protein, 10 aa, Homo Sapiens
GTEMFEVYGT

SEQ ID NO: 11519 - protein, 10 aa, Homo Sapiens
YGTPGVDIYI

SEQ ID NO: 11520 - protein, 10 aa, Homo Sapiens
HEPLPLAYAV

SEQ ID NO: 11521 - protein, 10 aa, Homo Sapiens
PLAYAVLYLT

SEQ ID NO: 11522 - protein, 10 aa, Homo Sapiens
VMVLRTQGPA

SEQ ID NO: 11523 - protein, 10 aa, Homo Sapiens
LRTQGPAALF

SEQ ID NO: 11524 - protein, 10 aa, Homo Sapiens
DAKRAQVFHI

SEQ ID NO: 11525 - protein, 10 aa, Homo Sapiens
EDVCEAYRHV

SEQ ID NO: 11526 - protein, 10 aa, Homo Sapiens
DAGFTGLISF

SEQ ID NO: 11527 - protein, 10 aa, Homo Sapiens
LDDSNEDFSA

SEQ ID NO: 11528 - protein, 10 aa, Homo Sapiens
SNEDFSASPI

SEQ ID NO: 11529 - protein, 10 aa, Homo Sapiens
TVVFRVAPWI

SEQ ID NO: 11530 - protein, 10 aa, Homo Sapiens
VYVCRVRNNT

SEQ ID NO: 11531 - protein, 10 aa, Homo Sapiens
DAVAELARKA

SEQ ID NO: 11532 - protein, 10 aa, Homo Sapiens
GCKLTICPQA

SEQ ID NO: 11533 - protein, 10 aa, Homo Sapiens
ELQDFPYKRI

SEQ ID NO: 11534 - protein, 10 aa, Homo Sapiens
PYKRILGPDF

SEQ ID NO: 11535 - protein, 10 aa, Homo Sapiens
VRDFLHAQKV

SEQ ID NO: 11536 - protein, 10 aa, Homo Sapiens
QKVQPPVELF

SEQ ID NO: 11537 - protein, 10 aa, Homo Sapiens
GHVDEFLSFV

SEQ ID NO: 11538 - protein, 10 aa, Homo Sapiens
FVPAPDGKGF

SEQ ID NO: 11539 - protein, 10 aa, Homo Sapiens
FQGVVDDEQV

SEQ ID NO: 11540 - protein, 10 aa, Homo Sapiens
DDEQVKTISI

SEQ ID NO: 11541 - protein, 10 aa, Homo Sapiens
NKDLINYNKF

SEQ ID NO: 11542 - protein, 10 aa, Homo Sapiens
NYNKFVQSCI

SEQ ID NO: 11543 - protein, 10 aa, Homo Sapiens
GLAECDIIDI

SEQ ID NO: 11544 - protein, 10 aa, Homo Sapiens
LFKTERKKAT

SEQ ID NO: 11545 - protein, 10 aa, Homo Sapiens
FKTERKKATA

SEQ ID NO: 11546 - protein, 10 aa, Homo Sapiens
GKHLGIPKPF

SEQ ID NO: 11547 - protein, 10 aa, Homo Sapiens
LLEPLGLHCT

SEQ ID NO: 11548 - protein, 10 aa, Homo Sapiens
LHCTFIDDFT

SEQ ID NO: 11549 - protein, 10 aa, Homo Sapiens
FIDDFTPYHM

SEQ ID NO: 11550 - protein, 10 aa, Homo Sapiens
HGEVHCGTNV

SEQ ID NO: 11551 - protein, 10 aa, Homo Sapiens
WRFDATLEII

SEQ ID NO: 11552 - protein, 10 aa, Homo Sapiens
PSNDLNDSHV

SEQ ID NO: 11553 - protein, 10 aa, Homo Sapiens
DVQDNCDQHV

SEQ ID NO: 11554 - protein, 10 aa, Homo Sapiens
VHCLQDLEDM

SEQ ID NO: 11555 - protein, 10 aa, Homo Sapiens
CLQDLEDMSV

SEQ ID NO: 11556 - protein, 10 aa, Homo Sapiens
RTQGPAALFD

SEQ ID NO: 11557 - protein, 10 aa, Homo Sapiens
LVLHTSSYDA

SEQ ID NO: 11558 - protein, 10 aa, Homo Sapiens
AKRAQVFHIC

SEQ ID NO: 11559 - protein, 10 aa, Homo Sapiens
VFHICGPEDV

SEQ ID NO: 11560 - protein, 10 aa, Homo Sapiens
YRHVLGQDKV

SEQ ID NO: 11561 - protein, 10 aa, Homo Sapiens
LGQDKVSYEV

SEQ ID NO: 11562 - protein, 10 aa, Homo Sapiens
PRLHGDEERF

SEQ ID NO: 11563 - protein, 10 aa, Homo Sapiens
TLLDDSNEDF

SEQ ID NO: 11564 - protein, 10 aa, Homo Sapiens
VVFRVAPWIM

SEQ ID NO: 11565 - protein, 10 aa, Homo Sapiens
CFVDAVAELA

SEQ ID NO: 11566 - protein, 10 aa, Homo Sapiens
QAENRNDRWI

SEQ ID NO: 11567 - protein, 10 aa, Homo Sapiens
LGYVQAPHKT

SEQ ID NO: 11568 - protein, 10 aa, Homo Sapiens
EVSPPVVANG

SEQ ID NO: 11569 - protein, 10 aa, Homo Sapiens
ANGKEYPLGR

SEQ ID NO: 11570 - protein, 10 aa, Homo Sapiens
NGKEYPLGRI

SEQ ID NO: 11571 - protein, 10 aa, Homo Sapiens
PVELFVDWLA

SEQ ID NO: 11572 - protein, 10 aa, Homo Sapiens
PAPDGKGFRM

SEQ ID NO: 11573 - protein, 10 aa, Homo Sapiens
QVKTISINQV

SEQ ID NO: 11574 - protein, 10 aa, Homo Sapiens
NQVLSNKDLI

SEQ ID NO: 11575 - protein, 10 aa, Homo Sapiens
QSCIDWNREV

SEQ ID NO: 11576 - protein, 10 aa, Homo Sapiens
CDIIDIPQLF

SEQ ID NO: 11577 - protein, 10 aa, Homo Sapiens
ATAFFPDLVN

SEQ ID NO: 11578 - protein, 10 aa, Homo Sapiens
FFPDLVNMLV

SEQ ID NO: 11579 - protein, 10 aa, Homo Sapiens
NGCCCLEEKV

SEQ ID NO: 11580 - protein, 10 aa, Homo Sapiens
LEPLGLHCTF

SEQ ID NO: 11581 - protein, 10 aa, Homo Sapiens
GLHCTFIDDF

SEQ ID NO: 11582 - protein, 10 aa, Homo Sapiens
TNVCRKPFSF

SEQ ID NO: 11583 - protein, 10 aa, Homo Sapiens
RERADTRRWR

SEQ ID NO: 11584 - protein, 10 aa, Homo Sapiens
ATLEIIVVMN

SEQ ID NO: 11585 - protein, 10 aa, Homo Sapiens
MNSPSNDLND

SEQ ID NO: 11586 - protein, 10 aa, Homo Sapiens
SGYGGILLVN

SEQ ID NO: 11587 - protein, 10 aa, Homo Sapiens
GYGGILLVNC

SEQ ID NO: 11588 - protein, 10 aa, Homo Sapiens
RDDPSCDVQD

SEQ ID NO: 11589 - protein, 10 aa, Homo Sapiens
YDAKRAQVFH

SEQ ID NO: 11590 - protein, 10 aa, Homo Sapiens
PDAGFTGLIS

SEQ ID NO: 11591 - protein, 10 aa, Homo Sapiens
LISFHVTLLD

SEQ ID NO: 11592 - protein, 10 aa, Homo Sapiens
RVAPWIMTPS

SEQ ID NO: 11593 - protein, 10 aa, Homo Sapiens
WIMTPSTLPP

SEQ ID NO: 11594 - protein, 10 aa, Homo Sapiens
FVDAVAELAR

SEQ ID NO: 11595 - protein, 10 aa, Homo Sapiens
AVAELARKAG

SEQ ID NO: 11596 - protein, 10 aa, Homo Sapiens
RKAGCKLTIC

SEQ ID NO: 11597 - protein, 10 aa, Homo Sapiens
RDRSVSGLDS

SEQ ID NO: 11598 - protein, 10 aa, Homo Sapiens
PGSSGRRVTQ

SEQ ID NO: 11599 - protein, 10 aa, Homo Sapiens
SGRRVTQVVR

SEQ ID NO: 11600 - protein, 10 aa, Homo Sapiens
GRRVTQVVRD

SEQ ID NO: 11601 - protein, 10 aa, Homo Sapiens
CGHGRALLFQ

SEQ ID NO: 11602 - protein, 10 aa, Homo Sapiens
ALLFQGVVDD

SEQ ID NO: 11603 - protein, 10 aa, Homo Sapiens
TISINQVLSN

SEQ ID NO: 11604 - protein, 10 aa, Homo Sapiens
KHLGIPKPFG

SEQ ID NO: 11605 - protein, 10 aa, Homo Sapiens
IINGCCCLEE

SEQ ID NO: 11606 - protein, 10 aa, Homo Sapiens
LVDIYGSVPE

SEQ ID NO: 11607 - protein, 10 aa, Homo Sapiens
RGRERADTRR

SEQ ID NO: 11608 - protein, 10 aa, Homo Sapiens
DISLDCDLNC

SEQ ID NO: 11609 - protein, 10 aa, Homo Sapiens
EGRQDRNFVD

SEQ ID NO: 11610 - protein, 10 aa, Homo Sapiens
FVDKRQWVWG

SEQ ID NO: 11611 - protein, 10 aa, Homo Sapiens
HICGPEDVCE

SEQ ID NO: 11612 - protein, 10 aa, Homo Sapiens
CEAYRHVLGQ

SEQ ID NO: 11613 - protein, 10 aa, Homo Sapiens
AYRHVLGQDK

SEQ ID NO: 11614 - protein, 10 aa, Homo Sapiens
HVLGQDKVSY

SEQ ID NO: 11615 - protein, 10 aa, Homo Sapiens
DDSNEDFSAS

SEQ ID NO: 11616 - protein, 10 aa, Homo Sapiens
PIFTDTVVFR

SEQ ID NO: 11617 - protein, 10 aa, Homo Sapiens
TDTVVFRVAP

SEQ ID NO: 11618 - protein, 10 aa, Homo Sapiens
RVRNNTCFVD

SEQ ID NO: 11619 - protein, 10 aa, Homo Sapiens
AGCKLTICPQ

SEQ ID NO: 11620 - protein, 10 aa, Homo Sapiens
MELGYVQAPH

SEQ ID NO: 11621 - protein, 10 aa, Homo Sapiens
PHKTLPVVFD

SEQ ID NO: 11622 - protein, 10 aa, Homo Sapiens
SVSGLDSFGN

SEQ ID NO: 11623 - protein, 10 aa, Homo Sapiens
DSFGNLEVSP

SEQ ID NO: 11624 - protein, 10 aa, Homo Sapiens
LEVSPPVVAN

SEQ ID NO: 11625 - protein, 10 aa, Homo Sapiens
RILIGGNLPG

SEQ ID NO: 11626 - protein, 10 aa, Homo Sapiens
ILIGGNLPGS

SEQ ID NO: 11627 - protein, 10 aa, Homo Sapiens
GKGFRMLLAS

SEQ ID NO: 11628 - protein, 10 aa, Homo Sapiens
RALLFQGVVD

SEQ ID NO: 11629 - protein, 10 aa, Homo Sapiens
IDWNREVLKR

SEQ ID NO: 11630 - protein, 10 aa, Homo Sapiens
RKKATAFFPD

SEQ ID NO: 11631 - protein, 10 aa, Homo Sapiens
KVRSLLEPLG

SEQ ID NO: 11632 - protein, 10 aa, Homo Sapiens
LQRIVRVSLE

SEQ ID NO: 11633 - protein, 10 aa, Homo Sapiens
AGVETLVDIY

SEQ ID NO: 11634 - protein, 10 aa, Homo Sapiens
PEGTEMFEVY

SEQ ID NO: 11635 - protein, 10 aa, Homo Sapiens
EGTEMFEVYG

SEQ ID NO: 11636 - protein, 10 aa, Homo Sapiens
EMFEVYGTPG

SEQ ID NO: 11637 - protein, 10 aa, Homo Sapiens
YISPNMERGR

SEQ ID NO: 11638 - protein, 10 aa, Homo Sapiens
RADTRRWRFD

SEQ ID NO: 11639 - protein, 10 aa, Homo Sapiens
SSHEPLPLAY

SEQ ID NO: 11640 - protein, 10 aa, Homo Sapiens
LAYAVLYLTC

SEQ ID NO: 11641 - protein, 10 aa, Homo Sapiens
GRQDRNFVDK

SEQ ID NO: 11642 - protein, 10 aa, Homo Sapiens
RQDRNFVDKR

SEQ ID NO: 11643 - protein, 10 aa, Homo Sapiens
DKRQWVWGPS

SEQ ID NO: 11644 - protein, 10 aa, Homo Sapiens
LEDMSVMVLR

SEQ ID NO: 11645 - protein, 10 aa, Homo Sapiens
LFDDHKLVLH

SEQ ID NO: 11646 - protein, 10 aa, Homo Sapiens
TSSYDAKRAQ

SEQ ID NO: 11647 - protein, 10 aa, Homo Sapiens
AQVFHICGPE

SEQ ID NO: 11648 - protein, 10 aa, Homo Sapiens
VCEAYRHVLG

SEQ ID NO: 11649 - protein, 10 aa, Homo Sapiens
GQDKVSYEVP

SEQ ID NO: 11650 - protein, 10 aa, Homo Sapiens
QDKVSYEVPR

SEQ ID NO: 11651 - protein, 10 aa, Homo Sapiens
KVSYEVPRLH

SEQ ID NO: 11652 - protein, 10 aa, Homo Sapiens
VSYEVPRLHG

SEQ ID NO: 11653 - protein, 10 aa, Homo Sapiens
HGDEERFFVE

SEQ ID NO: 11654 - protein, 10 aa, Homo Sapiens
GDEERFFVEG

SEQ ID NO: 11655 - protein, 10 aa, Homo Sapiens
EERFFVEGLS

SEQ ID NO: 11656 - protein, 10 aa, Homo Sapiens
AGFTGLISFH

SEQ ID NO: 11657 - protein, 10 aa, Homo Sapiens
ISFHVTLLDD

SEQ ID NO: 11658 - protein, 10 aa, Homo Sapiens
DFSASPIFTD

SEQ ID NO: 11659 - protein, 10 aa, Homo Sapiens
DTVVFRVAPW

SEQ ID NO: 11660 - protein, 10 aa, Homo Sapiens
TLPPLEVYVC

SEQ ID NO: 11661 - protein, 10 aa, Homo Sapiens
LEVYVCRVRN

SEQ ID NO: 11662 - protein, 10 aa, Homo Sapiens
NTCFVDAVAE

SEQ ID NO: 11663 - protein, 10 aa, Homo Sapiens
AELARKAGCK

SEQ ID NO: 11664 - protein, 10 aa, Homo Sapiens
KAGCKLTICP

SEQ ID NO: 11665 - protein, 10 aa, Homo Sapiens
AENRNDRWIQ

SEQ ID NO: 11666 - protein, 10 aa, Homo Sapiens
ENRNDRWIQD

SEQ ID NO: 11667 - protein, 10 aa, Homo Sapiens
EMELGYVQAP

SEQ ID NO: 11668 - protein, 10 aa, Homo Sapiens
ELGYVQAPHK

SEQ ID NO: 11669 - protein, 10 aa, Homo Sapiens
KTLPVVFDSP

SEQ ID NO: 11670 - protein, 10 aa, Homo Sapiens
FDSPRNGELQ

SEQ ID NO: 11671 - protein, 10 aa, Homo Sapiens
PRNGELQDFP

SEQ ID NO: 11672 - protein, 10 aa, Homo Sapiens
RNGELQDFPY

SEQ ID NO: 11673 - protein, 10 aa, Homo Sapiens
YKRILGPDFG

SEQ ID NO: 11674 - protein, 10 aa, Homo Sapiens
PDFGYVTREP

SEQ ID NO: 11675 - protein, 10 aa, Homo Sapiens
DFGYVTREPR

SEQ ID NO: 11676 - protein, 10 aa, Homo Sapiens
TREPRDRSVS

SEQ ID NO: 11677 - protein, 10 aa, Homo Sapiens
REPRDRSVSG

SEQ ID NO: 11678 - protein, 10 aa, Homo Sapiens
LDSFGNLEVS

SEQ ID NO: 11679 - protein, 10 aa, Homo Sapiens
SFGNLEVSPP

SEQ ID NO: 11680 - protein, 10 aa, Homo Sapiens
VANGKEYPLG

SEQ ID NO: 11681 - protein, 10 aa, Homo Sapiens
EYPLGRILIG

SEQ ID NO: 11682 - protein, 10 aa, Homo Sapiens
LIGGNLPGSS

SEQ ID NO: 11683 - protein, 10 aa, Homo Sapiens
VVRDFLHAQK

SEQ ID NO: 11684 - protein, 10 aa, Homo Sapiens
FLHAQKVQPP

SEQ ID NO: 11685 - protein, 10 aa, Homo Sapiens
HAQKVQPPVE

SEQ ID NO: 11686 - protein, 10 aa, Homo Sapiens
ELFVDWLAVG

SEQ ID NO: 11687 - protein, 10 aa, Homo Sapiens
DWLAVGHVDE

SEQ ID NO: 11688 - protein, 10 aa, Homo Sapiens
AVGHVDEFLS

SEQ ID NO: 11689 - protein, 10 aa, Homo Sapiens
DEFLSFVPAP

SEQ ID NO: 11690 - protein, 10 aa, Homo Sapiens
EFLSFVPAPD

SEQ ID NO: 11691 - protein, 10 aa, Homo Sapiens
FLSFVPAPDG

SEQ ID NO: 11692 - protein, 10 aa, Homo Sapiens
GFRMLLASPG

SEQ ID NO: 11693 - protein, 10 aa, Homo Sapiens
ACFKLFQEKQ

SEQ ID NO: 11694 - protein, 10 aa, Homo Sapiens
KTISINQVLS

SEQ ID NO: 11695 - protein, 10 aa, Homo Sapiens
LINYNKFVQS

SEQ ID NO: 11696 - protein, 10 aa, Homo Sapiens
CIDWNREVLK

SEQ ID NO: 11697 - protein, 10 aa, Homo Sapiens
VLKRELGLAE

SEQ ID NO: 11698 - protein, 10 aa, Homo Sapiens
LKRELGLAEC

SEQ ID NO: 11699 - protein, 10 aa, Homo Sapiens
AECDIIDIPQ

SEQ ID NO: 11700 - protein, 10 aa, Homo Sapiens
DIIDIPQLFK

SEQ ID NO: 11701 - protein, 10 aa, Homo Sapiens
IDIPQLFKTE

SEQ ID NO: 11702 - protein, 10 aa, Homo Sapiens
ERKKATAFFP

SEQ ID NO: 11703 - protein, 10 aa, Homo Sapiens
DLVNMLVLGK

SEQ ID NO: 11704 - protein, 10 aa, Homo Sapiens
VLGKHLGIPK

SEQ ID NO: 11705 - protein, 10 aa, Homo Sapiens
LEEKVRSLLE

SEQ ID NO: 11706 - protein, 10 aa, Homo Sapiens
EEKVRSLLEP

SEQ ID NO: 11707 - protein, 10 aa, Homo Sapiens
CTFIDDFTPY

SEQ ID NO: 11708 - protein, 10 aa, Homo Sapiens
DFTPYHMLHG

SEQ ID NO: 11709 - protein, 10 aa, Homo Sapiens
YHMLHGEVHC

SEQ ID NO: 11710 - protein, 10 aa, Homo Sapiens
EVHCGTNVCR

SEQ ID NO: 11711 - protein, 10 aa, Homo Sapiens
VHCGTNVCRK

SEQ ID NO: 11712 - protein, 10 aa, Homo Sapiens
VCRKPFSFKW

SEQ ID NO: 11713 - protein, 10 aa, Homo Sapiens
MSLQRIVRVS

SEQ ID NO: 11714 - protein, 10 aa, Homo Sapiens
QRIVRVSLEH

SEQ ID NO: 11715 - protein, 10 aa, Homo Sapiens
SLEHPTSAVC

SEQ ID NO: 11716 - protein, 10 aa, Homo Sapiens
TSAVCVAGVE

SEQ ID NO: 11717 - protein, 10 aa, Homo Sapiens
VDIYGSVPEG

SEQ ID NO: 11718 - protein, 10 aa, Homo Sapiens
IYGSVPEGTE

SEQ ID NO: 11719 - protein, 10 aa, Homo Sapiens
VYGTPGVDIY

SEQ ID NO: 11720 - protein, 10 aa, Homo Sapiens
GTPGVDIYIS

SEQ ID NO: 11721 - protein, 10 aa, Homo Sapiens
ISPNMERGRE

SEQ ID NO: 11722 - protein, 10 aa, Homo Sapiens
ERGRERADTR

SEQ ID NO: 11723 - protein, 10 aa, Homo Sapiens
RRWRFDATLE

SEQ ID NO: 11724 - protein, 10 aa, Homo Sapiens
EIIVVMNSPS

SEQ ID NO: 11725 - protein, 10 aa, Homo Sapiens
IIVVMNSPSN

SEQ ID NO: 11726 - protein, 10 aa, Homo Sapiens
SNDLNDSHVQ

SEQ ID NO: 11727 - protein, 10 aa, Homo Sapiens
NDSHVQISYH

SEQ ID NO: 11728 - protein, 10 aa, Homo Sapiens
QISYHSSHEP

SEQ ID NO: 11729 - protein, 10 aa, Homo Sapiens
PLPLAYAVLY

SEQ ID NO: 11730 - protein, 10 aa, Homo Sapiens
YAVLYLTCVD

SEQ ID NO: 11731 - protein, 10 aa, Homo Sapiens
LTCVDISLDC

SEQ ID NO: 11732 - protein, 10 aa, Homo Sapiens
QDRNFVDKRQ

SEQ ID NO: 11733 - protein, 10 aa, Homo Sapiens
KRQWVWGPSG

SEQ ID NO: 11734 - protein, 10 aa, Homo Sapiens
WVWGPSGYGG

SEQ ID NO: 11735 - protein, 10 aa, Homo Sapiens
YGGILLVNCD

SEQ ID NO: 11736 - protein, 10 aa, Homo Sapiens
DRDDPSCDVQ

SEQ ID NO: 11737 - protein, 10 aa, Homo Sapiens
VQDNCDQHVH

SEQ ID NO: 11738 - protein, 10 aa, Homo Sapiens
QDNCDQHVHC

SEQ ID NO: 11739 - protein, 10 aa, Homo Sapiens
CDQHVHCLQD

SEQ ID NO: 11740 - protein, 10 aa, Homo Sapiens
HVHCLQDLED

SEQ ID NO: 11741 - protein, 10 aa, Homo Sapiens
DMSVMVLRTQ

SEQ ID NO: 11742 - protein, 10 aa, Homo Sapiens
MSVMVLRTQG

SEQ ID NO: 11743 - protein, 10 aa, Homo Sapiens
SVMVLRTQGP

SEQ ID NO: 11744 - protein, 10 aa, Homo Sapiens
TQGPAALFDD

SEQ ID NO: 11745 - protein, 10 aa, Homo Sapiens
QGPAALFDDH

SEQ ID NO: 11746 - protein, 10 aa, Homo Sapiens
KRAQVFHICG

SEQ ID NO: 11747 - protein, 10 aa, Homo Sapiens
RHVLGQDKVS

SEQ ID NO: 11748 - protein, 10 aa, Homo Sapiens
VLGQDKVSYE

SEQ ID NO: 11749 - protein, 10 aa, Homo Sapiens
RFFVEGLSFP

SEQ ID NO: 11750 - protein, 10 aa, Homo Sapiens
VEGLSFPDAG

SEQ ID NO: 11751 - protein, 10 aa, Homo Sapiens
LLDDSNEDFS

SEQ ID NO: 11752 - protein, 10 aa, Homo Sapiens
EVYVCRVRNN

SEQ ID NO: 11753 - protein, 10 aa, Homo Sapiens
VDAVAELARK

SEQ ID NO: 11754 - protein, 10 aa, Homo Sapiens
KLTICPQAEN

SEQ ID NO: 11755 - protein, 10 aa, Homo Sapiens
NDRWIQDEME

SEQ ID NO: 11756 - protein, 10 aa, Homo Sapiens
WIQDEMELGY

SEQ ID NO: 11757 - protein, 10 aa, Homo Sapiens
YVQAPHKTLP

SEQ ID NO: 11758 - protein, 10 aa, Homo Sapiens
DSPRNGELQD

SEQ ID NO: 11759 - protein, 10 aa, Homo Sapiens
NGELQDFPYK

SEQ ID NO: 11760 - protein, 10 aa, Homo Sapiens
QDFPYKRILG

SEQ ID NO: 11761 - protein, 10 aa, Homo Sapiens
DFPYKRILGP

SEQ ID NO: 11762 - protein, 10 aa, Homo Sapiens
LGPDFGYVTR

SEQ ID NO: 11763 - protein, 10 aa, Homo Sapiens
RSVSGLDSFG

SEQ ID NO: 11764 - protein, 10 aa, Homo Sapiens
IGGNLPGSSG

SEQ ID NO: 11765 - protein, 10 aa, Homo Sapiens
RDFLHAQKVQ

SEQ ID NO: 11766 - protein, 10 aa, Homo Sapiens
DFLHAQKVQP

SEQ ID NO: 11767 - protein, 10 aa, Homo Sapiens
VQPPVELFVD

SEQ ID NO: 11768 - protein, 10 aa, Homo Sapiens
LFVDWLAVGH

SEQ ID NO: 11769 - protein, 10 aa, Homo Sapiens
HVDEFLSFVP

SEQ ID NO: 11770 - protein, 10 aa, Homo Sapiens
KGFRMLLASP

SEQ ID NO: 11771 - protein, 10 aa, Homo Sapiens
RMLLASPGAC

SEQ ID NO: 11772 - protein, 10 aa, Homo Sapiens
LLASPGACFK

SEQ ID NO: 11773 - protein, 10 aa, Homo Sapiens
LFQGVVDDEQ

SEQ ID NO: 11774 - protein, 10 aa, Homo Sapiens
VDDEQVKTIS

SEQ ID NO: 11775 - protein, 10 aa, Homo Sapiens
EQVKTISINQ

SEQ ID NO: 11776 - protein, 10 aa, Homo Sapiens
QVLSNKDLIN

SEQ ID NO: 11777 - protein, 10 aa, Homo Sapiens
VLSNKDLINY

SEQ ID NO: 11778 - protein, 10 aa, Homo Sapiens
INYNKFVQSC

SEQ ID NO: 11779 - protein, 10 aa, Homo Sapiens
VQSCIDWNRE

SEQ ID NO: 11780 - protein, 10 aa, Homo Sapiens
PDLVNMLVLG

SEQ ID NO: 11781 - protein, 10 aa, Homo Sapiens
LVLGKHLGIP

SEQ ID NO: 11782 - protein, 10 aa, Homo Sapiens
PFGPIINGCC

SEQ ID NO: 11783 - protein, 10 aa, Homo Sapiens
INGCCCLEEK

SEQ ID NO: 11784 - protein, 10 aa, Homo Sapiens
CCCLEEKVRS

SEQ ID NO: 11785 - protein, 10 aa, Homo Sapiens
SLLEPLGLHC

SEQ ID NO: 11786 - protein, 10 aa, Homo Sapiens
PLGLHCTFID

SEQ ID NO: 11787 - protein, 10 aa, Homo Sapiens
TFIDDFTPYH

SEQ ID NO: 11788 - protein, 10 aa, Homo Sapiens
GEVHCGTNVC

SEQ ID NO: 11789 - protein, 10 aa, Homo Sapiens
GTNVCRKPFS

SEQ ID NO: 11790 - protein, 10 aa, Homo Sapiens
NVCRKPFSFK

SEQ ID NO: 11791 - protein, 10 aa, Homo Sapiens
CRKPFSFKWW

SEQ ID NO: 11792 - protein, 10 aa, Homo Sapiens
FSFKWWNMVP

SEQ ID NO: 11793 - protein, 10 aa, Homo Sapiens
RIVRVSLEHP

SEQ ID NO: 11794 - protein, 10 aa, Homo Sapiens
VRVSLEHPTS

SEQ ID NO: 11795 - protein, 10 aa, Homo Sapiens
TLVDIYGSVP

SEQ ID NO: 11796 - protein, 10 aa, Homo Sapiens
SVPEGTEMFE

SEQ ID NO: 11797 - protein, 10 aa, Homo Sapiens
TEMFEVYGTP

SEQ ID NO: 11798 - protein, 10 aa, Homo Sapiens
FEVYGTPGVD

SEQ ID NO: 11799 - protein, 10 aa, Homo Sapiens
PGVDIYISPN

SEQ ID NO: 11800 - protein, 10 aa, Homo Sapiens
IYISPNMERG

SEQ ID NO: 11801 - protein, 10 aa, Homo Sapiens
NMERGRERAD

SEQ ID NO: 11802 - protein, 10 aa, Homo Sapiens
GRERADTRRW

SEQ ID NO: 11803 - protein, 10 aa, Homo Sapiens
TLEIIVVMNS

SEQ ID NO: 11804 - protein, 10 aa, Homo Sapiens
IVVMNSPSND

SEQ ID NO: 11805 - protein, 10 aa, Homo Sapiens
DLNDSHVQIS

SEQ ID NO: 11806 - protein, 10 aa, Homo Sapiens
LNDSHVQISY

SEQ ID NO: 11807 - protein, 10 aa, Homo Sapiens
SYHSSHEPLP

SEQ ID NO: 11808 - protein, 10 aa, Homo Sapiens
VLYLTCVDIS

SEQ ID NO: 11809 - protein, 10 aa, Homo Sapiens
ISLDCDLNCE

SEQ ID NO: 11810 - protein, 10 aa, Homo Sapiens
SLDCDLNCEG

SEQ ID NO: 11811 - protein, 10 aa, Homo Sapiens
DCDLNCEGRQ

SEQ ID NO: 11812 - protein, 10 aa, Homo Sapiens
DLNCEGRQDR

SEQ ID NO: 11813 - protein, 10 aa, Homo Sapiens
NFVDKRQWVW

SEQ ID NO: 11814 - protein, 10 aa, Homo Sapiens
VDKRQWVWGP

SEQ ID NO: 11815 - protein, 10 aa, Homo Sapiens
RQWVWGPSGY

SEQ ID NO: 11816 - protein, 10 aa, Homo Sapiens
ILLVNCDRDD

SEQ ID NO: 11817 - protein, 10 aa, Homo Sapiens
LLVNCDRDDP

SEQ ID NO: 11818 - protein, 10 aa, Homo Sapiens
LVNCDRDDPS

SEQ ID NO: 11819 - protein, 10 aa, Homo Sapiens
VNCDRDDPSC

SEQ ID NO: 11820 - protein, 10 aa, Homo Sapiens
NCDRDDPSCD

SEQ ID NO: 11821 - protein, 10 aa, Homo Sapiens
DDPSCDVQDN

SEQ ID NO: 11822 - protein, 10 aa, Homo Sapiens
SCDVQDNCDQ

SEQ ID NO: 11823 - protein, 10 aa, Homo Sapiens
NCDQHVHCLQ

SEQ ID NO: 11824 - protein, 10 aa, Homo Sapiens
DDHKLVLHTS

SEQ ID NO: 11825 - protein, 10 aa, Homo Sapiens
DHKLVLHTSS

SEQ ID NO: 11826 - protein, 10 aa, Homo Sapiens
HKLVLHTSSY

SEQ ID NO: 11827 - protein, 10 aa, Homo Sapiens
KLVLHTSSYD

SEQ ID NO: 11828 - protein, 10 aa, Homo Sapiens
VLHTSSYDAK

SEQ ID NO: 11829 - protein, 10 aa, Homo Sapiens
LHTSSYDAKR

SEQ ID NO: 11830 - protein, 10 aa, Homo Sapiens
RAQVFHICGP

SEQ ID NO: 11831 - protein, 10 aa, Homo Sapiens
QVFHICGPED

SEQ ID NO: 11832 - protein, 10 aa, Homo Sapiens
FHICGPEDVC

SEQ ID NO: 11833 - protein, 10 aa, Homo Sapiens
CGPEDVCEAY

SEQ ID NO: 11834 - protein, 10 aa, Homo Sapiens
PEDVCEAYRH

SEQ ID NO: 11835 - protein, 10 aa, Homo Sapiens
EAYRHVLGQD

SEQ ID NO: 11836 - protein, 10 aa, Homo Sapiens
YEVPRLHGDE

SEQ ID NO: 11837 - protein, 10 aa, Homo Sapiens
EVPRLHGDEE

SEQ ID NO: 11838 - protein, 10 aa, Homo Sapiens
FFVEGLSFPD

SEQ ID NO: 11839 - protein, 10 aa, Homo Sapiens
LSFPDAGFTG

SEQ ID NO: 11840 - protein, 10 aa, Homo Sapiens
DSNEDFSASP

SEQ ID NO: 11841 - protein, 10 aa, Homo Sapiens
FRVAPWIMTP

SEQ ID NO: 11842 - protein, 10 aa, Homo Sapiens
PWIMTPSTLP

SEQ ID NO: 11843 - protein, 10 aa, Homo Sapiens
MTPSTLPPLE

SEQ ID NO: 11844 - protein, 10 aa, Homo Sapiens
PSTLPPLEVY

SEQ ID NO: 11845 - protein, 10 aa, Homo Sapiens
PLEVYVCRVR

SEQ ID NO: 11846 - protein, 10 aa, Homo Sapiens
VAELARKAGC

SEQ ID NO: 11847 - protein, 10 aa, Homo Sapiens
CKLTICPQAE

SEQ ID NO: 11848 - protein, 10 aa, Homo Sapiens
TICPQAENRN

SEQ ID NO: 11849 - protein, 10 aa, Homo Sapiens
ICPQAENRND

SEQ ID NO: 11850 - protein, 10 aa, Homo Sapiens
PQAENRNDRW

SEQ ID NO: 11851 - protein, 10 aa, Homo Sapiens
RWIQDEMELG

SEQ ID NO: 11852 - protein, 10 aa, Homo Sapiens
QDEMELGYVQ

SEQ ID NO: 11853 - protein, 10 aa, Homo Sapiens
HKTLPVVFDS

SEQ ID NO: 11854 - protein, 10 aa, Homo Sapiens
TLPVVFDSPR

SEQ ID NO: 11855 - protein, 10 aa, Homo Sapiens
VVFDSPRNGE

SEQ ID NO: 11856 - protein, 10 aa, Homo Sapiens
KRILGPDFGY

SEQ ID NO: 11857 - protein, 10 aa, Homo Sapiens
FGYVTREPRD

SEQ ID NO: 11858 - protein, 10 aa, Homo Sapiens
YVTREPRDRS

SEQ ID NO: 11859 - protein, 10 aa, Homo Sapiens
PRDRSVSGLD

SEQ ID NO: 11860 - protein, 10 aa, Homo Sapiens
VSPPVVANGK

SEQ ID NO: 11861 - protein, 10 aa, Homo Sapiens
PVVANGKEYP

SEQ ID NO: 11862 - protein, 10 aa, Homo Sapiens
PLGRILIGGN

SEQ ID NO: 11863 - protein, 10 aa, Homo Sapiens
GNLPGSSGRR

SEQ ID NO: 11864 - protein, 10 aa, Homo Sapiens
QVVRDFLHAQ

SEQ ID NO: 11865 - protein, 10 aa, Homo Sapiens
VDWLAVGHVD

SEQ ID NO: 11866 - protein, 10 aa, Homo Sapiens
SFVPAPDGKG

SEQ ID NO: 11867 - protein, 10 aa, Homo Sapiens
PGACFKLFQE

SEQ ID NO: 11868 - protein, 10 aa, Homo Sapiens
GACFKLFQEK

SEQ ID NO: 11869 - protein, 10 aa, Homo Sapiens
KLFQEKQKCG

SEQ ID NO: 11870 - protein, 10 aa, Homo Sapiens
FQEKQKCGHG

SEQ ID NO: 11871 - protein, 10 aa, Homo Sapiens
GHGRALLFQG

SEQ ID NO: 11872 - protein, 10 aa, Homo Sapiens
LLFQGVVDDE

SEQ ID NO: 11873 - protein, 10 aa, Homo Sapiens
QGVVDDEQVK

SEQ ID NO: 11874 - protein, 10 aa, Homo Sapiens
ISINQVLSNK

SEQ ID NO: 11875 - protein, 10 aa, Homo Sapiens
LSNKDLINYN

SEQ ID NO: 11876 - protein, 10 aa, Homo Sapiens
DLINYNKFVQ

SEQ ID NO: 11877 - protein, 10 aa, Homo Sapiens
KFVQSCIDWN

SEQ ID NO: 11878 - protein, 10 aa, Homo Sapiens
NREVLKRELG

SEQ ID NO: 11879 - protein, 10 aa, Homo Sapiens
KRELGLAECD

SEQ ID NO: 11880 - protein, 10 aa, Homo Sapiens
LGLAECDIID

SEQ ID NO: 11881 - protein, 10 aa, Homo Sapiens
DIPQLFKTER

SEQ ID NO: 11882 - protein, 10 aa, Homo Sapiens
LGKHLGIPKP

SEQ ID NO: 11883 - protein, 10 aa, Homo Sapiens
HLGIPKPFGP

SEQ ID NO: 11884 - protein, 10 aa, Homo Sapiens
GCCCLEEKVR

SEQ ID NO: 11885 - protein, 10 aa, Homo Sapiens
RSLLEPLGLH

SEQ ID NO: 11886 - protein, 10 aa, Homo Sapiens
LGLHCTFIDD

SEQ ID NO: 11887 - protein, 10 aa, Homo Sapiens
PYHMLHGEVH

SEQ ID NO: 11888 - protein, 10 aa, Homo Sapiens
HMLHGEVHCG

SEQ ID NO: 11889 - protein, 10 aa, Homo Sapiens
LHGEVHCGTN

SEQ ID NO: 11890 - protein, 10 aa, Homo Sapiens
HCGTNVCRKP

SEQ ID NO: 11891 - protein, 10 aa, Homo Sapiens
RKPFSFKWWN

SEQ ID NO: 11892 - protein, 10 aa, Homo Sapiens
TPSTLAPLEV

SEQ ID NO: 11893 - protein, 10 aa, Homo Sapiens
APLEVYVCRV

SEQ ID NO: 11894 - protein, 10 aa, Homo Sapiens
IMTPSTLAPL

SEQ ID NO: 11895 - protein, 10 aa, Homo Sapiens
STLAPLEVYV

SEQ ID NO: 11896 - protein, 10 aa, Homo Sapiens
PWIMTPSTLA

SEQ ID NO: 11897 - protein, 10 aa, Homo Sapiens
WIMTPSTLAP

SEQ ID NO: 11898 - protein, 10 aa, Homo Sapiens
TLAPLEVYVC

SEQ ID NO: 11899 - protein, 10 aa, Homo Sapiens
LAPLEVYVCR

SEQ ID NO: 11900 - protein, 10 aa, Homo Sapiens
MTPSTLAPLE

SEQ ID NO: 11901 - protein, 10 aa, Homo Sapiens
PSTLAPLEVY

SEQ ID NO: 11902 - protein, 10 aa, Homo Sapiens
VPDGKGFRML

SEQ ID NO: 11903 - protein, 10 aa, Homo Sapiens
VPVPDGKGFR

SEQ ID NO: 11904 - protein, 10 aa, Homo Sapiens
VDEFLSFVPV

SEQ ID NO: 11905 - protein, 10 aa, Homo Sapiens
FVPVPDGKGF

SEQ ID NO: 11906 - protein, 10 aa, Homo Sapiens
PVPDGKGFRM

SEQ ID NO: 11907 - protein, 10 aa, Homo Sapiens
EFLSFVPVPD

SEQ ID NO: 11908 - protein, 10 aa, Homo Sapiens
FLSFVPVPDG

SEQ ID NO: 11909 - protein, 10 aa, Homo Sapiens
DEFLSFVPVP

SEQ ID NO: 11910 - protein, 10 aa, Homo Sapiens
KEYPLGRILI

SEQ ID NO: 11911 - protein, 10 aa, Homo Sapiens
PEGTEMFEVY

SEQ ID NO: 11912 - protein, 10 aa, Homo Sapiens
LEPLGLHCTF

SEQ ID NO: 11913 - protein, 10 aa, Homo Sapiens
DEERFFVEGL

SEQ ID NO: 11914 - protein, 10 aa, Homo Sapiens
NEDFSASPIF

SEQ ID NO: 11915 - protein, 10 aa, Homo Sapiens
REVLKRELGL

SEQ ID NO: 11916 - protein, 10 aa, Homo Sapiens
TERKKATAFF

SEQ ID NO: 11917 - protein, 10 aa, Homo Sapiens
RELGLAECDI

SEQ ID NO: 11918 - protein, 10 aa, Homo Sapiens
AFFPDLVNML

SEQ ID NO: 11919 - protein, 10 aa, Homo Sapiens
ASPGACFKLF

SEQ ID NO: 11920 - protein, 10 aa, Homo Sapiens
ALFDDHKLVL

SEQ ID NO: 11921 - protein, 10 aa, Homo Sapiens
EPLPLAYAVL

SEQ ID NO: 11922 - protein, 10 aa, Homo Sapiens
SPIFTDTVVF

SEQ ID NO: 11923 - protein, 10 aa, Homo Sapiens
APDGKGFRML

SEQ ID NO: 11924 - protein, 10 aa, Homo Sapiens
SCIDWNREVL

SEQ ID NO: 11925 - protein, 10 aa, Homo Sapiens
ECDIIDIPQL

SEQ ID NO: 11926 - protein, 10 aa, Homo Sapiens
APHKTLPVVF

SEQ ID NO: 11927 - protein, 10 aa, Homo Sapiens
DEFLSFVPAP

SEQ ID NO: 11928 - protein, 10 aa, Homo Sapiens
CRKPFSFKWW

SEQ ID NO: 11929 - protein, 10 aa, Homo Sapiens
LEHPTSAVCV

SEQ ID NO: 11930 - protein, 10 aa, Homo Sapiens
AVCVAGVETL

SEQ ID NO: 11931 - protein, 10 aa, Homo Sapiens
SSHEPLPLAY

SEQ ID NO: 11932 - protein, 10 aa, Homo Sapiens
HEPLPLAYAV

SEQ ID NO: 11933 - protein, 10 aa, Homo Sapiens
PLPLAYAVLY

SEQ ID NO: 11934 - protein, 10 aa, Homo Sapiens
ERFFVEGLSF

SEQ ID NO: 11935 - protein, 10 aa, Homo Sapiens
GLISFHVTLL

SEQ ID NO: 11936 - protein, 10 aa, Homo Sapiens
APWIMTPSTL

SEQ ID NO: 11937 - protein, 10 aa, Homo Sapiens
AELARKAGCK

SEQ ID NO: 11938 - protein, 10 aa, Homo Sapiens
AENRNDRWIQ

SEQ ID NO: 11939 - protein, 10 aa, Homo Sapiens
KRILGPDFGY

SEQ ID NO: 11940 - protein, 10 aa, Homo Sapiens
AQKVQPPVEL

SEQ ID NO: 11941 - protein, 10 aa, Homo Sapiens
LASPGACFKL

SEQ ID NO: 11942 - protein, 10 aa, Homo Sapiens
NKDLINYNKF

SEQ ID NO: 11943 - protein, 10 aa, Homo Sapiens
AECDIIDIPQ

SEQ ID NO: 11944 - protein, 10 aa, Homo Sapiens
CDIIDIPQLF

SEQ ID NO: 11945 - protein, 10 aa, Homo Sapiens
KTERKKATAF

SEQ ID NO: 11946 - protein, 10 aa, Homo Sapiens
LGIPKPFGPI

SEQ ID NO: 11947 - protein, 10 aa, Homo Sapiens
SLQRIVRVSL

SEQ ID NO: 11948 - protein, 10 aa, Homo Sapiens
AGVETLVDIY

SEQ ID NO: 11949 - protein, 10 aa, Homo Sapiens
VETLVDIYGS

SEQ ID NO: 11950 - protein, 10 aa, Homo Sapiens
GSVPEGTEMF

SEQ ID NO: 11951 - protein, 10 aa, Homo Sapiens
ERADTRRWRF

SEQ ID NO: 11952 - protein, 10 aa, Homo Sapiens
LEIIVVMNSP

SEQ ID NO: 11953 - protein, 10 aa, Homo Sapiens
GPSGYGGILL

SEQ ID NO: 11954 - protein, 10 aa, Homo Sapiens
VLRTQGPAAL

SEQ ID NO: 11955 - protein, 10 aa, Homo Sapiens
SYDAKRAQVF

SEQ ID NO: 11956 - protein, 10 aa, Homo Sapiens
VEGLSFPDAG

SEQ ID NO: 11957 - protein, 10 aa, Homo Sapiens
SFPDAGFTGL

SEQ ID NO: 11958 - protein, 10 aa, Homo Sapiens
IMTPSTLPPL

SEQ ID NO: 11959 - protein, 10 aa, Homo Sapiens
ELARKAGCKL

SEQ ID NO: 11960 - protein, 10 aa, Homo Sapiens
EPRDRSVSGL

SEQ ID NO: 11961 - protein, 10 aa, Homo Sapiens
LEVSPPVVAN

SEQ ID NO: 11962 - protein, 10 aa, Homo Sapiens
VELFVDWLAV

SEQ ID NO: 11963 - protein, 10 aa, Homo Sapiens
KQKCGHGRAL

SEQ ID NO: 11964 - protein, 10 aa, Homo Sapiens
KCGHGRALLF

SEQ ID NO: 11965 - protein, 10 aa, Homo Sapiens
VVDDEQVKTI

SEQ ID NO: 11966 - protein, 10 aa, Homo Sapiens
VLSNKDLINY

SEQ ID NO: 11967 - protein, 10 aa, Homo Sapiens
NKFVQSCIDW

SEQ ID NO: 11968 - protein, 10 aa, Homo Sapiens
FPDLVNMLVL

SEQ ID NO: 11969 - protein, 10 aa, Homo Sapiens
VNMLVLGKHL

SEQ ID NO: 11970 - protein, 10 aa, Homo Sapiens
GKHLGIPKPF

SEQ ID NO: 11971 - protein, 10 aa, Homo Sapiens
EEKVRSLLEP

SEQ ID NO: 11972 - protein, 10 aa, Homo Sapiens
EKVRSLLEPL

SEQ ID NO: 11973 - protein, 10 aa, Homo Sapiens
VRSLLEPLGL

SEQ ID NO: 11974 - protein, 10 aa, Homo Sapiens
CGTNVCRKPF

SEQ ID NO: 11975 - protein, 10 aa, Homo Sapiens
GRERADTRRW

SEQ ID NO: 11976 - protein, 10 aa, Homo Sapiens
VVMNSPSNDL

SEQ ID NO: 11977 - protein, 10 aa, Homo Sapiens
NDLNDSHVQI

SEQ ID NO: 11978 - protein, 10 aa, Homo Sapiens
YHSSHEPLPL

SEQ ID NO: 11979 - protein, 10 aa, Homo Sapiens
LPLAYAVLYL

SEQ ID NO: 11980 - protein, 10 aa, Homo Sapiens
AVLYLTCVDI

SEQ ID NO: 11981 - protein, 10 aa, Homo Sapiens
LYLTCVDISL

SEQ ID NO: 11982 - protein, 10 aa, Homo Sapiens
NCEGRQDRNF

SEQ ID NO: 11983 - protein, 10 aa, Homo Sapiens
CEGRQDRNFV

SEQ ID NO: 11984 - protein, 10 aa, Homo Sapiens
NFVDKRQWVW

SEQ ID NO: 11985 - protein, 10 aa, Homo Sapiens
DNCDQHVHCL

SEQ ID NO: 11986 - protein, 10 aa, Homo Sapiens
DLEDMSVMVL

SEQ ID NO: 11987 - protein, 10 aa, Homo Sapiens
LEDMSVMVLR

SEQ ID NO: 11988 - protein, 10 aa, Homo Sapiens
PAALFDDHKL

SEQ ID NO: 11989 - protein, 10 aa, Homo Sapiens
CGPEDVCEAY

SEQ ID NO: 11990 - protein, 10 aa, Homo Sapiens
DVCEAYRHVL

SEQ ID NO: 11991 - protein, 10 aa, Homo Sapiens
HVLGQDKVSY

SEQ ID NO: 11992 - protein, 10 aa, Homo Sapiens
YEVPRLHGDE

SEQ ID NO: 11993 - protein, 10 aa, Homo Sapiens
EERFFVEGLS

SEQ ID NO: 11994 - protein, 10 aa, Homo Sapiens
EGLSFPDAGF

SEQ ID NO: 11995 - protein, 10 aa, Homo Sapiens
TGLISFHVTL

SEQ ID NO: 11996 - protein, 10 aa, Homo Sapiens
PSTLPPLEVY

SEQ ID NO: 11997 - protein, 10 aa, Homo Sapiens
TCFVDAVAEL

SEQ ID NO: 11998 - protein, 10 aa, Homo Sapiens
ARKAGCKLTI

SEQ ID NO: 11999 - protein, 10 aa, Homo Sapiens
DEMELGYVQA

SEQ ID NO: 12000 - protein, 10 aa, Homo Sapiens
GYVQAPHKTL

SEQ ID NO: 12001 - protein, 10 aa, Homo Sapiens
SPRNGELQDF

SEQ ID NO: 12002 - protein, 10 aa, Homo Sapiens
GELQDFPYKR

SEQ ID NO: 12003 - protein, 10 aa, Homo Sapiens
ELQDFPYKRI

SEQ ID NO: 12004 - protein, 10 aa, Homo Sapiens
REPRDRSVSG

SEQ ID NO: 12005 - protein, 10 aa, Homo Sapiens
RRVTQVVRDF

SEQ ID NO: 12006 - protein, 10 aa, Homo Sapiens
QPPVELFVDW

SEQ ID NO: 12007 - protein, 10 aa, Homo Sapiens
FVPAPDGKGF

SEQ ID NO: 12008 - protein, 10 aa, Homo Sapiens
QKCGHGRALL

SEQ ID NO: 12009 - protein, 10 aa, Homo Sapiens
DEQVKTISIN

SEQ ID NO: 12010 - protein, 10 aa, Homo Sapiens
KKATAFFPDL

SEQ ID NO: 12011 - protein, 10 aa, Homo Sapiens
GPIINGCCCL

SEQ ID NO: 12012 - protein, 10 aa, Homo Sapiens
CCLEEKVRSL

SEQ ID NO: 12013 - protein, 10 aa, Homo Sapiens
GLHCTFIDDF

SEQ ID NO: 12014 - protein, 10 aa, Homo Sapiens
CTFIDDFTPY

SEQ ID NO: 12015 - protein, 10 aa, Homo Sapiens
GEVHCGTNVC

SEQ ID NO: 12016 - protein, 10 aa, Homo Sapiens
TEMFEVYGTP

SEQ ID NO: 12017 - protein, 10 aa, Homo Sapiens
FEVYGTPGVD

SEQ ID NO: 12018 - protein, 10 aa, Homo Sapiens
EVYGTPGVDI

SEQ ID NO: 12019 - protein, 10 aa, Homo Sapiens
VYGTPGVDIY

SEQ ID NO: 12020 - protein, 10 aa, Homo Sapiens
YGTPGVDIYI

SEQ ID NO: 12021 - protein, 10 aa, Homo Sapiens
MERGRERADT

SEQ ID NO: 12022 - protein, 10 aa, Homo Sapiens
RERADTRRWR

SEQ ID NO: 12023 - protein, 10 aa, Homo Sapiens
WRFDATLEII

SEQ ID NO: 12024 - protein, 10 aa, Homo Sapiens
LNDSHVQISY

SEQ ID NO: 12025 - protein, 10 aa, Homo Sapiens
DRNFVDKRQW

SEQ ID NO: 12026 - protein, 10 aa, Homo Sapiens
LRTQGPAALF

SEQ ID NO: 12027 - protein, 10 aa, Homo Sapiens
HKLVLHTSSY

SEQ ID NO: 12028 - protein, 10 aa, Homo Sapiens
PEDVCEAYRH

SEQ ID NO: 12029 - protein, 10 aa, Homo Sapiens
CEAYRHVLGQ

SEQ ID NO: 12030 - protein, 10 aa, Homo Sapiens
RLHGDEERFF

SEQ ID NO: 12031 - protein, 10 aa, Homo Sapiens
DAGFTGLISF

SEQ ID NO: 12032 - protein, 10 aa, Homo Sapiens
TLLDDSNEDF

SEQ ID NO: 12033 - protein, 10 aa, Homo Sapiens
LEVYVCRVRN

SEQ ID NO: 12034 - protein, 10 aa, Homo Sapiens
WIQDEMELGY

SEQ ID NO: 12035 - protein, 10 aa, Homo Sapiens
MELGYVQAPH

SEQ ID NO: 12036 - protein, 10 aa, Homo Sapiens
LQDFPYKRIL

SEQ ID NO: 12037 - protein, 10 aa, Homo Sapiens
DRSVSGLDSF

SEQ ID NO: 12038 - protein, 10 aa, Homo Sapiens
VSGLDSFGNL

SEQ ID NO: 12039 - protein, 10 aa, Homo Sapiens
PPVVANGKEY

SEQ ID NO: 12040 - protein, 10 aa, Homo Sapiens
QKVQPPVELF

SEQ ID NO: 12041 - protein, 10 aa, Homo Sapiens
VGHVDEFLSF

SEQ ID NO: 12042 - protein, 10 aa, Homo Sapiens
PDGKGFRMLL

SEQ ID NO: 12043 - protein, 10 aa, Homo Sapiens
INQVLSNKDL

SEQ ID NO: 12044 - protein, 10 aa, Homo Sapiens
GLAECDIIDI

SEQ ID NO: 12045 - protein, 10 aa, Homo Sapiens
CLEEKVRSLL

SEQ ID NO: 12046 - protein, 10 aa, Homo Sapiens
LEEKVRSLLE

SEQ ID NO: 12047 - protein, 10 aa, Homo Sapiens
EPLGLHCTFI

SEQ ID NO: 12048 - protein, 10 aa, Homo Sapiens
IDDFTPYHML

SEQ ID NO: 12049 - protein, 10 aa, Homo Sapiens
TRRWRFDATL

SEQ ID NO: 12050 - protein, 10 aa, Homo Sapiens
CVDISLDCDL

SEQ ID NO: 12051 - protein, 10 aa, Homo Sapiens
RQWVWGPSGY

SEQ ID NO: 12052 - protein, 10 aa, Homo Sapiens
VWGPSGYGGI

SEQ ID NO: 12053 - protein, 10 aa, Homo Sapiens
WGPSGYGGIL

SEQ ID NO: 12054 - protein, 10 aa, Homo Sapiens
DQHVHCLQDL

SEQ ID NO: 12055 - protein, 10 aa, Homo Sapiens
DKVSYEVPRL

SEQ ID NO: 12056 - protein, 10 aa, Homo Sapiens
PRLHGDEERF

SEQ ID NO: 12057 - protein, 10 aa, Homo Sapiens
FPDAGFTGLI

SEQ ID NO: 12058 - protein, 10 aa, Homo Sapiens
SNEDFSASPI

SEQ ID NO: 12059 - protein, 10 aa, Homo Sapiens
DTVVFRVAPW

SEQ ID NO: 12060 - protein, 10 aa, Homo Sapiens
VFDSPRNGEL

SEQ ID NO: 12061 - protein, 10 aa, Homo Sapiens
PYKRILGPDF

SEQ ID NO: 12062 - protein, 10 aa, Homo Sapiens
VVANGKEYPL

SEQ ID NO: 12063 - protein, 10 aa, Homo Sapiens
GKEYPLGRIL

SEQ ID NO: 12064 - protein, 10 aa, Homo Sapiens
RVTQVVRDFL

SEQ ID NO: 12065 - protein, 10 aa, Homo Sapiens
PPVELFVDWL

SEQ ID NO: 12066 - protein, 10 aa, Homo Sapiens
WLAVGHVDEF

SEQ ID NO: 12067 - protein, 10 aa, Homo Sapiens
LAVGHVDEFL

SEQ ID NO: 12068 - protein, 10 aa, Homo Sapiens
MLLASPGACF

SEQ ID NO: 12069 - protein, 10 aa, Homo Sapiens
QEKQKCGHGR

SEQ ID NO: 12070 - protein, 10 aa, Homo Sapiens
VKTISINQVL

SEQ ID NO: 12071 - protein, 10 aa, Homo Sapiens
NQVLSNKDLI

SEQ ID NO: 12072 - protein, 10 aa, Homo Sapiens
WNREVLKREL

SEQ ID NO: 12073 - protein, 10 aa, Homo Sapiens
ELGLAECDII

SEQ ID NO: 12074 - protein, 10 aa, Homo Sapiens
TNVCRKPFSF

SEQ ID NO: 12075 - protein, 10 aa, Homo Sapiens
VCRKPFSFKW

SEQ ID NO: 12076 - protein, 10 aa, Homo Sapiens
VAGVETLVDI

SEQ ID NO: 12077 - protein, 10 aa, Homo Sapiens
RWRFDATLEI

SEQ ID NO: 12078 - protein, 10 aa, Homo Sapiens
ISYHSSHEPL

SEQ ID NO: 12079 - protein, 10 aa, Homo Sapiens
DAKRAQVFHI

SEQ ID NO: 12080 - protein, 10 aa, Homo Sapiens
VCRVRNNTCF

SEQ ID NO: 12081 - protein, 10 aa, Homo Sapiens
PQAENRNDRW

SEQ ID NO: 12082 - protein, 10 aa, Homo Sapiens
QAENRNDRWI

SEQ ID NO: 12083 - protein, 10 aa, Homo Sapiens
DRWIQDEMEL

SEQ ID NO: 12084 - protein, 10 aa, Homo Sapiens
RNGELQDFPY

SEQ ID NO: 12085 - protein, 10 aa, Homo Sapiens
NGKEYPLGRI

SEQ ID NO: 12086 - protein, 10 aa, Homo Sapiens
LGRILIGGNL

SEQ ID NO: 12087 - protein, 10 aa, Homo Sapiens
DDEQVKTISI

SEQ ID NO: 12088 - protein, 10 aa, Homo Sapiens
IDIPQLFKTE

SEQ ID NO: 12089 - protein, 10 aa, Homo Sapiens
MLVLGKHLGI

SEQ ID NO: 12090 - protein, 10 aa, Homo Sapiens
AGFTGLISFH

SEQ ID NO: 12091 - protein, 10 aa, Homo Sapiens
TVVFRVAPWI

SEQ ID NO: 12092 - protein, 10 aa, Homo Sapiens
NYNKFVQSCI

SEQ ID NO: 12093 - protein, 10 aa, Homo Sapiens
GIPKPFGPII

SEQ ID NO: 12094 - protein, 10 aa, Homo Sapiens
AVAELARKAG

SEQ ID NO: 12095 - protein, 10 aa, Homo Sapiens
QDFPYKRILG

SEQ ID NO: 12096 - protein, 10 aa, Homo Sapiens
EYPLGRILIG

SEQ ID NO: 12097 - protein, 10 aa, Homo Sapiens
KPFGPIINGC

SEQ ID NO: 12098 - protein, 10 aa, Homo Sapiens
AALFDDHKLV

SEQ ID NO: 12099 - protein, 10 aa, Homo Sapiens
SASPIFTDTV

SEQ ID NO: 12100 - protein, 10 aa, Homo Sapiens
EVSPPVVANG

SEQ ID NO: 12101 - protein, 10 aa, Homo Sapiens
EHPTSAVCVA

SEQ ID NO: 12102 - protein, 10 aa, Homo Sapiens
FDATLEIIVV

SEQ ID NO: 12103 - protein, 10 aa, Homo Sapiens
DATLEIIVVM

SEQ ID NO: 12104 - protein, 10 aa, Homo Sapiens
ATLEIIVVMN

SEQ ID NO: 12105 - protein, 10 aa, Homo Sapiens
RDDPSCDVQD

SEQ ID NO: 12106 - protein, 10 aa, Homo Sapiens
LSFPDAGFTG

SEQ ID NO: 12107 - protein, 10 aa, Homo Sapiens
EDFSASPIFT

SEQ ID NO: 12108 - protein, 10 aa, Homo Sapiens
STLPPLEVYV

SEQ ID NO: 12109 - protein, 10 aa, Homo Sapiens
TLPPLEVYVC

SEQ ID NO: 12110 - protein, 10 aa, Homo Sapiens
AGCKLTICPQ

SEQ ID NO: 12111 - protein, 10 aa, Homo Sapiens
EMELGYVQAP

SEQ ID NO: 12112 - protein, 10 aa, Homo Sapiens
KTLPVVFDSP

SEQ ID NO: 12113 - protein, 10 aa, Homo Sapiens
VSPPVVANGK

SEQ ID NO: 12114 - protein, 10 aa, Homo Sapiens
GRILIGGNLP

SEQ ID NO: 12115 - protein, 10 aa, Homo Sapiens
RDFLHAQKVQ

SEQ ID NO: 12116 - protein, 10 aa, Homo Sapiens
VQPPVELFVD

SEQ ID NO: 12117 - protein, 10 aa, Homo Sapiens
ELFVDWLAVG

SEQ ID NO: 12118 - protein, 10 aa, Homo Sapiens
ACFKLFQEKQ

SEQ ID NO: 12119 - protein, 10 aa, Homo Sapiens
ALLFQGVVDD

SEQ ID NO: 12120 - protein, 10 aa, Homo Sapiens
QVKTISINQV

SEQ ID NO: 12121 - protein, 10 aa, Homo Sapiens
KTISINQVLS

SEQ ID NO: 12122 - protein, 10 aa, Homo Sapiens
QLFKTERKKA

SEQ ID NO: 12123 - protein, 10 aa, Homo Sapiens
GTPGVDIYIS

SEQ ID NO: 12124 - protein, 10 aa, Homo Sapiens
VDIYISPNME

SEQ ID NO: 12125 - protein, 10 aa, Homo Sapiens
YISPNMERGR

SEQ ID NO: 12126 - protein, 10 aa, Homo Sapiens
NMERGRERAD

SEQ ID NO: 12127 - protein, 10 aa, Homo Sapiens
ERGRERADTR

SEQ ID NO: 12128 - protein, 10 aa, Homo Sapiens
ADTRRWRFDA

SEQ ID NO: 12129 - protein, 10 aa, Homo Sapiens
EIIVVMNSPS

SEQ ID NO: 12130 - protein, 10 aa, Homo Sapiens
MNSPSNDLND

SEQ ID NO: 12131 - protein, 10 aa, Homo Sapiens
SNDLNDSHVQ

SEQ ID NO: 12132 - protein, 10 aa, Homo Sapiens
NDSHVQISYH

SEQ ID NO: 12133 - protein, 10 aa, Homo Sapiens
SHEPLPLAYA

SEQ ID NO: 12134 - protein, 10 aa, Homo Sapiens
PSGYGGILLV

SEQ ID NO: 12135 - protein, 10 aa, Homo Sapiens
SGYGGILLVN

SEQ ID NO: 12136 - protein, 10 aa, Homo Sapiens
EDMSVMVLRT

SEQ ID NO: 12137 - protein, 10 aa, Homo Sapiens
LFDDHKLVLH

SEQ ID NO: 12138 - protein, 10 aa, Homo Sapiens
AKRAQVFHIC

SEQ ID NO: 12139 - protein, 10 aa, Homo Sapiens
EAYRHVLGQD

SEQ ID NO: 12140 - protein, 10 aa, Homo Sapiens
KVSYEVPRLH

SEQ ID NO: 12141 - protein, 10 aa, Homo Sapiens
DDSNEDFSAS

SEQ ID NO: 12142 - protein, 10 aa, Homo Sapiens
DFSASPIFTD

SEQ ID NO: 12143 - protein, 10 aa, Homo Sapiens
ASPIFTDTVV

SEQ ID NO: 12144 - protein, 10 aa, Homo Sapiens
PIFTDTVVFR

SEQ ID NO: 12145 - protein, 10 aa, Homo Sapiens
FTDTVVFRVA

SEQ ID NO: 12146 - protein, 10 aa, Homo Sapiens
NTCFVDAVAE

SEQ ID NO: 12147 - protein, 10 aa, Homo Sapiens
CKLTICPQAE

SEQ ID NO: 12148 - protein, 10 aa, Homo Sapiens
ENRNDRWIQD

SEQ ID NO: 12149 - protein, 10 aa, Homo Sapiens
NRNDRWIQDE

SEQ ID NO: 12150 - protein, 10 aa, Homo Sapiens
VQAPHKTLPV

SEQ ID NO: 12151 - protein, 10 aa, Homo Sapiens
VVFDSPRNGE

SEQ ID NO: 12152 - protein, 10 aa, Homo Sapiens
FDSPRNGELQ

SEQ ID NO: 12153 - protein, 10 aa, Homo Sapiens
DFPYKRILGP

SEQ ID NO: 12154 - protein, 10 aa, Homo Sapiens
PDFGYVTREP

SEQ ID NO: 12155 - protein, 10 aa, Homo Sapiens
TREPRDRSVS

SEQ ID NO: 12156 - protein, 10 aa, Homo Sapiens
SGLDSFGNLE

SEQ ID NO: 12157 - protein, 10 aa, Homo Sapiens
ANGKEYPLGR

SEQ ID NO: 12158 - protein, 10 aa, Homo Sapiens
ILIGGNLPGS

SEQ ID NO: 12159 - protein, 10 aa, Homo Sapiens
QVVRDFLHAQ

SEQ ID NO: 12160 - protein, 10 aa, Homo Sapiens
KVQPPVELFV

SEQ ID NO: 12161 - protein, 10 aa, Homo Sapiens
SFVPAPDGKG

SEQ ID NO: 12162 - protein, 10 aa, Homo Sapiens
KGFRMLLASP

SEQ ID NO: 12163 - protein, 10 aa, Homo Sapiens
RMLLASPGAC

SEQ ID NO: 12164 - protein, 10 aa, Homo Sapiens
KLFQEKQKCG

SEQ ID NO: 12165 - protein, 10 aa, Homo Sapiens
ISINQVLSNK

SEQ ID NO: 12166 - protein, 10 aa, Homo Sapiens
DLINYNKFVQ

SEQ ID NO: 12167 - protein, 10 aa, Homo Sapiens
EVLKRELGLA

SEQ ID NO: 12168 - protein, 10 aa, Homo Sapiens
DIIDIPQLFK

SEQ ID NO: 12169 - protein, 10 aa, Homo Sapiens
LFKTERKKAT

SEQ ID NO: 12170 - protein, 10 aa, Homo Sapiens
ATAFFPDLVN

SEQ ID NO: 12171 - protein, 10 aa, Homo Sapiens
IPKPFGPIIN

SEQ ID NO: 12172 - protein, 10 aa, Homo Sapiens
PKPFGPIING

SEQ ID NO: 12173 - protein, 10 aa, Homo Sapiens
PIINGCCCLE

SEQ ID NO: 12174 - protein, 10 aa, Homo Sapiens
LLEPLGLHCT

SEQ ID NO: 12175 - protein, 10 aa, Homo Sapiens
TFIDDFTPYH

SEQ ID NO: 12176 - protein, 10 aa, Homo Sapiens
MSLQRIVRVS

SEQ ID NO: 12177 - protein, 10 aa, Homo Sapiens
QRIVRVSLEH

SEQ ID NO: 12178 - protein, 10 aa, Homo Sapiens
VSLEHPTSAV

SEQ ID NO: 12179 - protein, 10 aa, Homo Sapiens
CVAGVETLVD

SEQ ID NO: 12180 - protein, 10 aa, Homo Sapiens
VDIYGSVPEG

SEQ ID NO: 12181 - protein, 10 aa, Homo Sapiens
EMFEVYGTPG

SEQ ID NO: 12182 - protein, 10 aa, Homo Sapiens
PGVDIYISPN

SEQ ID NO: 12183 - protein, 10 aa, Homo Sapiens
DTRRWRFDAT

SEQ ID NO: 12184 - protein, 10 aa, Homo Sapiens
NSPSNDLNDS

SEQ ID NO: 12185 - protein, 10 aa, Homo Sapiens
AYAVLYLTCV

SEQ ID NO: 12186 - protein, 10 aa, Homo Sapiens
YLTCVDISLD

SEQ ID NO: 12187 - protein, 10 aa, Homo Sapiens
VDISLDCDLN

SEQ ID NO: 12188 - protein, 10 aa, Homo Sapiens
ISLDCDLNCE

SEQ ID NO: 12189 - protein, 10 aa, Homo Sapiens
CDLNCEGRQD

SEQ ID NO: 12190 - protein, 10 aa, Homo Sapiens
RQDRNFVDKR

SEQ ID NO: 12191 - protein, 10 aa, Homo Sapiens
GGILLVNCDR

SEQ ID NO: 12192 - protein, 10 aa, Homo Sapiens
NCDRDDPSCD

SEQ ID NO: 12193 - protein, 10 aa, Homo Sapiens
VQDNCDQHVH

SEQ ID NO: 12194 - protein, 10 aa, Homo Sapiens
DMSVMVLRTQ

SEQ ID NO: 12195 - protein, 10 aa, Homo Sapiens
MVLRTQGPAA

SEQ ID NO: 12196 - protein, 10 aa, Homo Sapiens
TQGPAALFDD

SEQ ID NO: 12197 - protein, 10 aa, Homo Sapiens
HTSSYDAKRA

SEQ ID NO: 12198 - protein, 10 aa, Homo Sapiens
TSSYDAKRAQ

SEQ ID NO: 12199 - protein, 10 aa, Homo Sapiens
SSYDAKRAQV

SEQ ID NO: 12200 - protein, 10 aa, Homo Sapiens
FHICGPEDVC

SEQ ID NO: 12201 - protein, 10 aa, Homo Sapiens
ICGPEDVCEA

SEQ ID NO: 12202 - protein, 10 aa, Homo Sapiens
RHVLGQDKVS

SEQ ID NO: 12203 - protein, 10 aa, Homo Sapiens
EVPRLHGDEE

SEQ ID NO: 12204 - protein, 10 aa, Homo Sapiens
FTGLISFHVT

SEQ ID NO: 12205 - protein, 10 aa, Homo Sapiens
LISFHVTLLD

SEQ ID NO: 12206 - protein, 10 aa, Homo Sapiens
ISFHVTLLDD

SEQ ID NO: 12207 - protein, 10 aa, Homo Sapiens
TDTVVFRVAP

SEQ ID NO: 12208 - protein, 10 aa, Homo Sapiens
VVFRVAPWIM

SEQ ID NO: 12209 - protein, 10 aa, Homo Sapiens
FRVAPWIMTP

SEQ ID NO: 12210 - protein, 10 aa, Homo Sapiens
PWIMTPSTLP

SEQ ID NO: 12211 - protein, 10 aa, Homo Sapiens
WIMTPSTLPP

SEQ ID NO: 12212 - protein, 10 aa, Homo Sapiens
TPSTLPPLEV

SEQ ID NO: 12213 - protein, 10 aa, Homo Sapiens
EVYVCRVRNN

SEQ ID NO: 12214 - protein, 10 aa, Homo Sapiens
RNNTCFVDAV

SEQ ID NO: 12215 - protein, 10 aa, Homo Sapiens
FVDAVAELAR

SEQ ID NO: 12216 - protein, 10 aa, Homo Sapiens
LTICPQAENR

SEQ ID NO: 12217 - protein, 10 aa, Homo Sapiens
TICPQAENRN

SEQ ID NO: 12218 - protein, 10 aa, Homo Sapiens
RWIQDEMELG

SEQ ID NO: 12219 - protein, 10 aa, Homo Sapiens
DSPRNGELQD

SEQ ID NO: 12220 - protein, 10 aa, Homo Sapiens
ILGPDFGYVT

SEQ ID NO: 12221 - protein, 10 aa, Homo Sapiens
LGPDFGYVTR

SEQ ID NO: 12222 - protein, 10 aa, Homo Sapiens
DSFGNLEVSP

SEQ ID NO: 12223 - protein, 10 aa, Homo Sapiens
NLEVSPPVVA

SEQ ID NO: 12224 - protein, 10 aa, Homo Sapiens
YPLGRILIGG

SEQ ID NO: 12225 - protein, 10 aa, Homo Sapiens
PLGRILIGGN

SEQ ID NO: 12226 - protein, 10 aa, Homo Sapiens
GNLPGSSGRR

SEQ ID NO: 12227 - protein, 10 aa, Homo Sapiens
NLPGSSGRRV

SEQ ID NO: 12228 - protein, 10 aa, Homo Sapiens
PGSSGRRVTQ

SEQ ID NO: 12229 - protein, 10 aa, Homo Sapiens
GSSGRRVTQV

SEQ ID NO: 12230 - protein, 10 aa, Homo Sapiens
SSGRRVTQVV

SEQ ID NO: 12231 - protein, 10 aa, Homo Sapiens
SGRRVTQVVR

SEQ ID NO: 12232 - protein, 10 aa, Homo Sapiens
AVGHVDEFLS

SEQ ID NO: 12233 - protein, 10 aa, Homo Sapiens
EFLSFVPAPD

SEQ ID NO: 12234 - protein, 10 aa, Homo Sapiens
GKGFRMLLAS

SEQ ID NO: 12235 - protein, 10 aa, Homo Sapiens
CFKLFQEKQK

SEQ ID NO: 12236 - protein, 10 aa, Homo Sapiens
RALLFQGVVD

SEQ ID NO: 12237 - protein, 10 aa, Homo Sapiens
LSNKDLINYN

SEQ ID NO: 12238 - protein, 10 aa, Homo Sapiens
KDLINYNKFV

SEQ ID NO: 12239 - protein, 10 aa, Homo Sapiens
KFVQSCIDWN

SEQ ID NO: 12240 - protein, 10 aa, Homo Sapiens
IDWNREVLKR

SEQ ID NO: 12241 - protein, 10 aa, Homo Sapiens
DWNREVLKRE

SEQ ID NO: 12242 - protein, 10 aa, Homo Sapiens
VLKRELGLAE

SEQ ID NO: 12243 - protein, 10 aa, Homo Sapiens
TAFFPDLVNM

SEQ ID NO: 12244 - protein, 10 aa, Homo Sapiens
PDLVNMLVLG

SEQ ID NO: 12245 - protein, 10 aa, Homo Sapiens
NMLVLGKHLG

SEQ ID NO: 12246 - protein, 10 aa, Homo Sapiens
LGKHLGIPKP

SEQ ID NO: 12247 - protein, 10 aa, Homo Sapiens
RSLLEPLGLH

SEQ ID NO: 12248 - protein, 10 aa, Homo Sapiens
DDFTPYHMLH

SEQ ID NO: 12249 - protein, 10 aa, Homo Sapiens
DFTPYHMLHG

SEQ ID NO: 12250 - protein, 10 aa, Homo Sapiens
RVSLEHPTSA

SEQ ID NO: 12251 - protein, 10 aa, Homo Sapiens
HPTSAVCVAG

SEQ ID NO: 12252 - protein, 10 aa, Homo Sapiens
ETLVDIYGSV

SEQ ID NO: 12253 - protein, 10 aa, Homo Sapiens
EGTEMFEVYG

SEQ ID NO: 12254 - protein, 10 aa, Homo Sapiens
IYISPNMERG

SEQ ID NO: 12255 - protein, 10 aa, Homo Sapiens
ISPNMERGRE

SEQ ID NO: 12256 - protein, 10 aa, Homo Sapiens
RADTRRWRFD

SEQ ID NO: 12257 - protein, 10 aa, Homo Sapiens
RRWRFDATLE

SEQ ID NO: 12258 - protein, 10 aa, Homo Sapiens
SPSNDLNDSH

SEQ ID NO: 12259 - protein, 10 aa, Homo Sapiens
VQISYHSSHE

SEQ ID NO: 12260 - protein, 10 aa, Homo Sapiens
HSSHEPLPLA

SEQ ID NO: 12261 - protein, 10 aa, Homo Sapiens
YAVLYLTCVD

SEQ ID NO: 12262 - protein, 10 aa, Homo Sapiens
DISLDCDLNC

SEQ ID NO: 12263 - protein, 10 aa, Homo Sapiens
EGRQDRNFVD

SEQ ID NO: 12264 - protein, 10 aa, Homo Sapiens
GRQDRNFVDK

SEQ ID NO: 12265 - protein, 10 aa, Homo Sapiens
QDRNFVDKRQ

SEQ ID NO: 12266 - protein, 10 aa, Homo Sapiens
RNFVDKRQWV

SEQ ID NO: 12267 - protein, 10 aa, Homo Sapiens
GYGGILLVNC

SEQ ID NO: 12268 - protein, 10 aa, Homo Sapiens
DRDDPSCDVQ

SEQ ID NO: 12269 - protein, 10 aa, Homo Sapiens
NCDQHVHCLQ

SEQ ID NO: 12270 - protein, 10 aa, Homo Sapiens
LQDLEDMSVM

SEQ ID NO: 12271 - protein, 10 aa, Homo Sapiens
SVMVLRTQGP

SEQ ID NO: 12272 - protein, 10 aa, Homo Sapiens
RTQGPAALFD

SEQ ID NO: 12273 - protein, 10 aa, Homo Sapiens
FDDHKLVLHT

SEQ ID NO: 12274 - protein, 10 aa, Homo Sapiens
DDHKLVLHTS

SEQ ID NO: 12275 - protein, 10 aa, Homo Sapiens
VLHTSSYDAK

SEQ ID NO: 12276 - protein, 10 aa, Homo Sapiens
RAQVFHICGP

SEQ ID NO: 12277 - protein, 10 aa, Homo Sapiens
AQVFHICGPE

SEQ ID NO: 12278 - protein, 10 aa, Homo Sapiens
EDVCEAYRHV

SEQ ID NO: 12279 - protein, 10 aa, Homo Sapiens
AYRHVLGQDK

SEQ ID NO: 12280 - protein, 10 aa, Homo Sapiens
SYEVPRLHGD

SEQ ID NO: 12281 - protein, 10 aa, Homo Sapiens
HGDEERFFVE

SEQ ID NO: 12282 - protein, 10 aa, Homo Sapiens
RFFVEGLSFP

SEQ ID NO: 12283 - protein, 10 aa, Homo Sapiens
VTLLDDSNED

SEQ ID NO: 12284 - protein, 10 aa, Homo Sapiens
RVAPWIMTPS

SEQ ID NO: 12285 - protein, 10 aa, Homo Sapiens
MTPSTLPPLE

SEQ ID NO: 12286 - protein, 10 aa, Homo Sapiens
LPPLEVYVCR

SEQ ID NO: 12287 - protein, 10 aa, Homo Sapiens
YVCRVRNNTC

SEQ ID NO: 12288 - protein, 10 aa, Homo Sapiens
VRNNTCFVDA

SEQ ID NO: 12289 - protein, 10 aa, Homo Sapiens
CFVDAVAELA

SEQ ID NO: 12290 - protein, 10 aa, Homo Sapiens
DAVAELARKA

SEQ ID NO: 12291 - protein, 10 aa, Homo Sapiens
LARKAGCKLT

SEQ ID NO: 12292 - protein, 10 aa, Homo Sapiens
KAGCKLTICP

SEQ ID NO: 12293 - protein, 10 aa, Homo Sapiens
ELGYVQAPHK

SEQ ID NO: 12294 - protein, 10 aa, Homo Sapiens
LGYVQAPHKT

SEQ ID NO: 12295 - protein, 10 aa, Homo Sapiens
QAPHKTLPVV

SEQ ID NO: 12296 - protein, 10 aa, Homo Sapiens
PHKTLPVVFD

SEQ ID NO: 12297 - protein, 10 aa, Homo Sapiens
NGELQDFPYK

SEQ ID NO: 12298 - protein, 10 aa, Homo Sapiens
RILGPDFGYV

SEQ ID NO: 12299 - protein, 10 aa, Homo Sapiens
GYVTREPRDR

SEQ ID NO: 12300 - protein, 10 aa, Homo Sapiens
PRDRSVSGLD

SEQ ID NO: 12301 - protein, 10 aa, Homo Sapiens
SVSGLDSFGN

SEQ ID NO: 12302 - protein, 10 aa, Homo Sapiens
LDSFGNLEVS

SEQ ID NO: 12303 - protein, 10 aa, Homo Sapiens
SFGNLEVSPP

SEQ ID NO: 12304 - protein, 10 aa, Homo Sapiens
GNLEVSPPVV

SEQ ID NO: 12305 - protein, 10 aa, Homo Sapiens
SPPVVANGKE

SEQ ID NO: 12306 - protein, 10 aa, Homo Sapiens
LPGSSGRRVT

SEQ ID NO: 12307 - protein, 10 aa, Homo Sapiens
VRDFLHAQKV

SEQ ID NO: 12308 - protein, 10 aa, Homo Sapiens
DFLHAQKVQP

SEQ ID NO: 12309 - protein, 10 aa, Homo Sapiens
LFVDWLAVGH

SEQ ID NO: 12310 - protein, 10 aa, Homo Sapiens
VDWLAVGHVD

SEQ ID NO: 12311 - protein, 10 aa, Homo Sapiens
LSFVPAPDGK

SEQ ID NO: 12312 - protein, 10 aa, Homo Sapiens
VPAPDGKGFR

SEQ ID NO: 12313 - protein, 10 aa, Homo Sapiens
DGKGFRMLLA

SEQ ID NO: 12314 - protein, 10 aa, Homo Sapiens
CGHGRALLFQ

SEQ ID NO: 12315 - protein, 10 aa, Homo Sapiens
GHGRALLFQG

SEQ ID NO: 12316 - protein, 10 aa, Homo Sapiens
LLFQGVVDDE

SEQ ID NO: 12317 - protein, 10 aa, Homo Sapiens
GVVDDEQVKT

SEQ ID NO: 12318 - protein, 10 aa, Homo Sapiens
EQVKTISINQ

SEQ ID NO: 12319 - protein, 10 aa, Homo Sapiens
TISINQVLSN

SEQ ID NO: 12320 - protein, 10 aa, Homo Sapiens
SINQVLSNKD

SEQ ID NO: 12321 - protein, 10 aa, Homo Sapiens
LINYNKFVQS

SEQ ID NO: 12322 - protein, 10 aa, Homo Sapiens
CIDWNREVLK

SEQ ID NO: 12323 - protein, 10 aa, Homo Sapiens
NREVLKRELG

SEQ ID NO: 12324 - protein, 10 aa, Homo Sapiens
KRELGLAECD

SEQ ID NO: 12325 - protein, 10 aa, Homo Sapiens
LAECDIIDIP

SEQ ID NO: 12326 - protein, 10 aa, Homo Sapiens
IIDIPQLFKT

SEQ ID NO: 12327 - protein, 10 aa, Homo Sapiens
PQLFKTERKK

SEQ ID NO: 12328 - protein, 10 aa, Homo Sapiens
ERKKATAFFP

SEQ ID NO: 12329 - protein, 10 aa, Homo Sapiens
KATAFFPDLV

SEQ ID NO: 12330 - protein, 10 aa, Homo Sapiens
FFPDLVNMLV

SEQ ID NO: 12331 - protein, 10 aa, Homo Sapiens
DLVNMLVLGK

SEQ ID NO: 12332 - protein, 10 aa, Homo Sapiens
LVLGKHLGIP

SEQ ID NO: 12333 - protein, 10 aa, Homo Sapiens
KHLGIPKPFG

SEQ ID NO: 12334 - protein, 10 aa, Homo Sapiens
PFGPIINGCC

SEQ ID NO: 12335 - protein, 10 aa, Homo Sapiens
GCCCLEEKVR

SEQ ID NO: 12336 - protein, 10 aa, Homo Sapiens
SLLEPLGLHC

SEQ ID NO: 12337 - protein, 10 aa, Homo Sapiens
LGLHCTFIDD

SEQ ID NO: 12338 - protein, 10 aa, Homo Sapiens
FIDDFTPYHM

SEQ ID NO: 12339 - protein, 10 aa, Homo Sapiens
FTPYHMLHGE

SEQ ID NO: 12340 - protein, 10 aa, Homo Sapiens
YHMLHGEVHC

SEQ ID NO: 12341 - protein, 10 aa, Homo Sapiens
HMLHGEVHCG

SEQ ID NO: 12342 - protein, 10 aa, Homo Sapiens
EVHCGTNVCR

SEQ ID NO: 12343 - protein, 10 aa, Homo Sapiens
HCGTNVCRKP

SEQ ID NO: 12344 - protein, 10 aa, Homo Sapiens
NVCRKPFSFK

SEQ ID NO: 12345 - protein, 10 aa, Homo Sapiens
KPFSFKWWNM

SEQ ID NO: 12346 - protein, 10 aa, Homo Sapiens
FSFKWWNMVP

SEQ ID NO: 12347 - protein, 10 aa, Homo Sapiens
LQRIVRVSLE

SEQ ID NO: 12348 - protein, 10 aa, Homo Sapiens
RIVRVSLEHP

SEQ ID NO: 12349 - protein, 10 aa, Homo Sapiens
SLEHPTSAVC

SEQ ID NO: 12350 - protein, 10 aa, Homo Sapiens
PTSAVCVAGV

SEQ ID NO: 12351 - protein, 10 aa, Homo Sapiens
TSAVCVAGVE

SEQ ID NO: 12352 - protein, 10 aa, Homo Sapiens
SAVCVAGVET

SEQ ID NO: 12353 - protein, 10 aa, Homo Sapiens
GVETLVDIYG

SEQ ID NO: 12354 - protein, 10 aa, Homo Sapiens
TLVDIYGSVP

SEQ ID NO: 12355 - protein, 10 aa, Homo Sapiens
LVDIYGSVPE

SEQ ID NO: 12356 - protein, 10 aa, Homo Sapiens
DIYGSVPEGT

SEQ ID NO: 12357 - protein, 10 aa, Homo Sapiens
SVPEGTEMFE

SEQ ID NO: 12358 - protein, 10 aa, Homo Sapiens
SPNMERGRER

SEQ ID NO: 12359 - protein, 10 aa, Homo Sapiens
PNMERGRERA

SEQ ID NO: 12360 - protein, 10 aa, Homo Sapiens
RFDATLEIIV

SEQ ID NO: 12361 - protein, 10 aa, Homo Sapiens
DLNDSHVQIS

SEQ ID NO: 12362 - protein, 10 aa, Homo Sapiens
SHVQISYHSS

SEQ ID NO: 12363 - protein, 10 aa, Homo Sapiens
QISYHSSHEP

SEQ ID NO: 12364 - protein, 10 aa, Homo Sapiens
SYHSSHEPLP

SEQ ID NO: 12365 - protein, 10 aa, Homo Sapiens
PLAYAVLYLT

SEQ ID NO: 12366 - protein, 10 aa, Homo Sapiens
LAYAVLYLTC

SEQ ID NO: 12367 - protein, 10 aa, Homo Sapiens
VLYLTCVDIS

SEQ ID NO: 12368 - protein, 10 aa, Homo Sapiens
TCVDISLDCD

SEQ ID NO: 12369 - protein, 10 aa, Homo Sapiens
SLDCDLNCEG

SEQ ID NO: 12370 - protein, 10 aa, Homo Sapiens
DCDLNCEGRQ

SEQ ID NO: 12371 - protein, 10 aa, Homo Sapiens
FVDKRQWVWG

SEQ ID NO: 12372 - protein, 10 aa, Homo Sapiens
VDKRQWVWGP

SEQ ID NO: 12373 - protein, 10 aa, Homo Sapiens
YGGILLVNCD

SEQ ID NO: 12374 - protein, 10 aa, Homo Sapiens
GILLVNCDRD

SEQ ID NO: 12375 - protein, 10 aa, Homo Sapiens
ILLVNCDRDD

SEQ ID NO: 12376 - protein, 10 aa, Homo Sapiens
LLVNCDRDDP

SEQ ID NO: 12377 - protein, 10 aa, Homo Sapiens
DDPSCDVQDN

SEQ ID NO: 12378 - protein, 10 aa, Homo Sapiens
PSCDVQDNCD

SEQ ID NO: 12379 - protein, 10 aa, Homo Sapiens
SCDVQDNCDQ

SEQ ID NO: 12380 - protein, 10 aa, Homo Sapiens
CDQHVHCLQD

SEQ ID NO: 12381 - protein, 10 aa, Homo Sapiens
VHCLQDLEDM

SEQ ID NO: 12382 - protein, 10 aa, Homo Sapiens
QDLEDMSVMV

SEQ ID NO: 12383 - protein, 10 aa, Homo Sapiens
MSVMVLRTQG

SEQ ID NO: 12384 - protein, 10 aa, Homo Sapiens
QGPAALFDDH

SEQ ID NO: 12385 - protein, 10 aa, Homo Sapiens
KLVLHTSSYD

SEQ ID NO: 12386 - protein, 10 aa, Homo Sapiens
KRAQVFHICG

SEQ ID NO: 12387 - protein, 10 aa, Homo Sapiens
QVFHICGPED

SEQ ID NO: 12388 - protein, 10 aa, Homo Sapiens
HICGPEDVCE

SEQ ID NO: 12389 - protein, 10 aa, Homo Sapiens
VCEAYRHVLG

SEQ ID NO: 12390 - protein, 10 aa, Homo Sapiens
GQDKVSYEVP

SEQ ID NO: 12391 - protein, 10 aa, Homo Sapiens
VSYEVPRLHG

SEQ ID NO: 12392 - protein, 10 aa, Homo Sapiens
LHGDEERFFV

SEQ ID NO: 12393 - protein, 10 aa, Homo Sapiens
GDEERFFVEG

SEQ ID NO: 12394 - protein, 10 aa, Homo Sapiens
FVEGLSFPDA

SEQ ID NO: 12395 - protein, 10 aa, Homo Sapiens
GLSFPDAGFT

SEQ ID NO: 12396 - protein, 10 aa, Homo Sapiens
PDAGFTGLIS

SEQ ID NO: 12397 - protein, 10 aa, Homo Sapiens
SFHVTLLDDS

SEQ ID NO: 12398 - protein, 10 aa, Homo Sapiens
LLDDSNEDFS

SEQ ID NO: 12399 - protein, 10 aa, Homo Sapiens
IFTDTVVFRV

SEQ ID NO: 12400 - protein, 10 aa, Homo Sapiens
VAPWIMTPST

SEQ ID NO: 12401 - protein, 10 aa, Homo Sapiens
PPLEVYVCRV

SEQ ID NO: 12402 - protein, 10 aa, Homo Sapiens
PLEVYVCRVR

SEQ ID NO: 12403 - protein, 10 aa, Homo Sapiens
VYVCRVRNNT

SEQ ID NO: 12404 - protein, 10 aa, Homo Sapiens
CRVRNNTCFV

SEQ ID NO: 12405 - protein, 10 aa, Homo Sapiens
RVRNNTCFVD

SEQ ID NO: 12406 - protein, 10 aa, Homo Sapiens
NNTCFVDAVA

SEQ ID NO: 12407 - protein, 10 aa, Homo Sapiens
RKAGCKLTIC

SEQ ID NO: 12408 - protein, 10 aa, Homo Sapiens
GCKLTICPQA

SEQ ID NO: 12409 - protein, 10 aa, Homo Sapiens
ICPQAENRND

SEQ ID NO: 12410 - protein, 10 aa, Homo Sapiens
CPQAENRNDR

SEQ ID NO: 12411 - protein, 10 aa, Homo Sapiens
RNDRWIQDEM

SEQ ID NO: 12412 - protein, 10 aa, Homo Sapiens
IQDEMELGYV

SEQ ID NO: 12413 - protein, 10 aa, Homo Sapiens
HKTLPVVFDS

SEQ ID NO: 12414 - protein, 10 aa, Homo Sapiens
PVVFDSPRNG

SEQ ID NO: 12415 - protein, 10 aa, Homo Sapiens
GPDFGYVTRE

SEQ ID NO: 12416 - protein, 10 aa, Homo Sapiens
YVTREPRDRS

SEQ ID NO: 12417 - protein, 10 aa, Homo Sapiens
GLDSFGNLEV

SEQ ID NO: 12418 - protein, 10 aa, Homo Sapiens
VANGKEYPLG

SEQ ID NO: 12419 - protein, 10 aa, Homo Sapiens
RILIGGNLPG

SEQ ID NO: 12420 - protein, 10 aa, Homo Sapiens
LIGGNLPGSS

SEQ ID NO: 12421 - protein, 10 aa, Homo Sapiens
GRRVTQVVRD

SEQ ID NO: 12422 - protein, 10 aa, Homo Sapiens
TQVVRDFLHA

SEQ ID NO: 12423 - protein, 10 aa, Homo Sapiens
VVRDFLHAQK

SEQ ID NO: 12424 - protein, 10 aa, Homo Sapiens
HAQKVQPPVE

SEQ ID NO: 12425 - protein, 10 aa, Homo Sapiens
PVELFVDWLA

SEQ ID NO: 12426 - protein, 10 aa, Homo Sapiens
FVDWLAVGHV

SEQ ID NO: 12427 - protein, 10 aa, Homo Sapiens
DWLAVGHVDE

SEQ ID NO: 12428 - protein, 10 aa, Homo Sapiens
GHVDEFLSFV

SEQ ID NO: 12429 - protein, 10 aa, Homo Sapiens
HVDEFLSFVP

SEQ ID NO: 12430 - protein, 10 aa, Homo Sapiens
VDEFLSFVPA

SEQ ID NO: 12431 - protein, 10 aa, Homo Sapiens
FLSFVPAPDG

SEQ ID NO: 12432 - protein, 10 aa, Homo Sapiens
PAPDGKGFRM

SEQ ID NO: 12433 - protein, 10 aa, Homo Sapiens
FRMLLASPGA

SEQ ID NO: 12434 - protein, 10 aa, Homo Sapiens
SPGACFKLFQ

SEQ ID NO: 12435 - protein, 10 aa, Homo Sapiens
PGACFKLFQE

SEQ ID NO: 12436 - protein, 10 aa, Homo Sapiens
FKLFQEKQKC

SEQ ID NO: 12437 - protein, 10 aa, Homo Sapiens
EKQKCGHGRA

SEQ ID NO: 12438 - protein, 10 aa, Homo Sapiens
GRALLFQGVV

SEQ ID NO: 12439 - protein, 10 aa, Homo Sapiens
QVLSNKDLIN

SEQ ID NO: 12440 - protein, 10 aa, Homo Sapiens
SNKDLINYNK

SEQ ID NO: 12441 - protein, 10 aa, Homo Sapiens
INYNKFVQSC

SEQ ID NO: 12442 - protein, 10 aa, Homo Sapiens
VQSCIDWNRE

SEQ ID NO: 12443 - protein, 10 aa, Homo Sapiens
LGLAECDIID

SEQ ID NO: 12444 - protein, 10 aa, Homo Sapiens
IPQLFKTERK

SEQ ID NO: 12445 - protein, 10 aa, Homo Sapiens
LVNMLVLGKH

SEQ ID NO: 12446 - protein, 10 aa, Homo Sapiens
IINGCCCLEE

SEQ ID NO: 12447 - protein, 10 aa, Homo Sapiens
NGCCCLEEKV

SEQ ID NO: 12448 - protein, 10 aa, Homo Sapiens
CCCLEEKVRS

SEQ ID NO: 12449 - protein, 10 aa, Homo Sapiens
KVRSLLEPLG

SEQ ID NO: 12450 - protein, 10 aa, Homo Sapiens
PLGLHCTFID

SEQ ID NO: 12451 - protein, 10 aa, Homo Sapiens
VHCGTNVCRK

SEQ ID NO: 12452 - protein, 10 aa, Homo Sapiens
PFSFKWWNMV

SEQ ID NO: 12453 - protein, 10 aa, Homo Sapiens
IVRVSLEHPT

SEQ ID NO: 12454 - protein, 10 aa, Homo Sapiens
VRVSLEHPTS

SEQ ID NO: 12455 - protein, 10 aa, Homo Sapiens
VCVAGVETLV

SEQ ID NO: 12456 - protein, 10 aa, Homo Sapiens
IYGSVPEGTE

SEQ ID NO: 12457 - protein, 10 aa, Homo Sapiens
YGSVPEGTEM

SEQ ID NO: 12458 - protein, 10 aa, Homo Sapiens
VPEGTEMFEV

SEQ ID NO: 12459 - protein, 10 aa, Homo Sapiens
GTEMFEVYGT

SEQ ID NO: 12460 - protein, 10 aa, Homo Sapiens
MFEVYGTPGV

SEQ ID NO: 12461 - protein, 10 aa, Homo Sapiens
TPGVDIYISP

SEQ ID NO: 12462 - protein, 10 aa, Homo Sapiens
GVDIYISPNM

SEQ ID NO: 12463 - protein, 10 aa, Homo Sapiens
TLEIIVVMNS

SEQ ID NO: 12464 - protein, 10 aa, Homo Sapiens
IVVMNSPSND

SEQ ID NO: 12465 - protein, 10 aa, Homo Sapiens
VMNSPSNDLN

SEQ ID NO: 12466 - protein, 10 aa, Homo Sapiens
PSNDLNDSHV

SEQ ID NO: 12467 - protein, 10 aa, Homo Sapiens
LTCVDISLDC

SEQ ID NO: 12468 - protein, 10 aa, Homo Sapiens
LDCDLNCEGR

SEQ ID NO: 12469 - protein, 10 aa, Homo Sapiens
DLNCEGRQDR

SEQ ID NO: 12470 - protein, 10 aa, Homo Sapiens
KRQWVWGPSG

SEQ ID NO: 12471 - protein, 10 aa, Homo Sapiens
WVWGPSGYGG

SEQ ID NO: 12472 - protein, 10 aa, Homo Sapiens
VNCDRDDPSC

SEQ ID NO: 12473 - protein, 10 aa, Homo Sapiens
CDRDDPSCDV

SEQ ID NO: 12474 - protein, 10 aa, Homo Sapiens
DPSCDVQDNC

SEQ ID NO: 12475 - protein, 10 aa, Homo Sapiens
CDVQDNCDQH

SEQ ID NO: 12476 - protein, 10 aa, Homo Sapiens
DVQDNCDQHV

SEQ ID NO: 12477 - protein, 10 aa, Homo Sapiens
QDNCDQHVHC

SEQ ID NO: 12478 - protein, 10 aa, Homo Sapiens
QHVHCLQDLE

SEQ ID NO: 12479 - protein, 10 aa, Homo Sapiens
HVHCLQDLED

SEQ ID NO: 12480 - protein, 10 aa, Homo Sapiens
HCLQDLEDMS

SEQ ID NO: 12481 - protein, 10 aa, Homo Sapiens
CLQDLEDMSV

SEQ ID NO: 12482 - protein, 10 aa, Homo Sapiens
VMVLRTQGPA

SEQ ID NO: 12483 - protein, 10 aa, Homo Sapiens
DHKLVLHTSS

SEQ ID NO: 12484 - protein, 10 aa, Homo Sapiens
LVLHTSSYDA

SEQ ID NO: 12485 - protein, 10 aa, Homo Sapiens
LHTSSYDAKR

SEQ ID NO: 12486 - protein, 10 aa, Homo Sapiens
YDAKRAQVFH

SEQ ID NO: 12487 - protein, 10 aa, Homo Sapiens
VFHICGPEDV

SEQ ID NO: 12488 - protein, 10 aa, Homo Sapiens
GPEDVCEAYR

SEQ ID NO: 12489 - protein, 10 aa, Homo Sapiens
YRHVLGQDKV

SEQ ID NO: 12490 - protein, 10 aa, Homo Sapiens
VLGQDKVSYE

SEQ ID NO: 12491 - protein, 10 aa, Homo Sapiens
LGQDKVSYEV

SEQ ID NO: 12492 - protein, 10 aa, Homo Sapiens
QDKVSYEVPR

SEQ ID NO: 12493 - protein, 10 aa, Homo Sapiens
VPRLHGDEER

SEQ ID NO: 12494 - protein, 10 aa, Homo Sapiens
GFTGLISFHV

SEQ ID NO: 12495 - protein, 10 aa, Homo Sapiens
FHVTLLDDSN

SEQ ID NO: 12496 - protein, 10 aa, Homo Sapiens
HVTLLDDSNE

SEQ ID NO: 12497 - protein, 10 aa, Homo Sapiens
LDDSNEDFSA

SEQ ID NO: 12498 - protein, 10 aa, Homo Sapiens
FSASPIFTDT

SEQ ID NO: 12499 - protein, 10 aa, Homo Sapiens
VFRVAPWIMT

SEQ ID NO: 12500 - protein, 10 aa, Homo Sapiens
VDAVAELARK

SEQ ID NO: 12501 - protein, 10 aa, Homo Sapiens
VAELARKAGC

SEQ ID NO: 12502 - protein, 10 aa, Homo Sapiens
KLTICPQAEN

SEQ ID NO: 12503 - protein, 10 aa, Homo Sapiens
NDRWIQDEME

SEQ ID NO: 12504 - protein, 10 aa, Homo Sapiens
QDEMELGYVQ

SEQ ID NO: 12505 - protein, 10 aa, Homo Sapiens
YVQAPHKTLP

SEQ ID NO: 12506 - protein, 10 aa, Homo Sapiens
TLPVVFDSPR

SEQ ID NO: 12507 - protein, 10 aa, Homo Sapiens
PRNGELQDFP

SEQ ID NO: 12508 - protein, 10 aa, Homo Sapiens
FPYKRILGPD

SEQ ID NO: 12509 - protein, 10 aa, Homo Sapiens
YKRILGPDFG

SEQ ID NO: 12510 - protein, 10 aa, Homo Sapiens
DFGYVTREPR

SEQ ID NO: 12511 - protein, 10 aa, Homo Sapiens
VTREPRDRSV

SEQ ID NO: 12512 - protein, 10 aa, Homo Sapiens
RDRSVSGLDS

SEQ ID NO: 12513 - protein, 10 aa, Homo Sapiens
FGNLEVSPPV

SEQ ID NO: 12514 - protein, 10 aa, Homo Sapiens
IGGNLPGSSG

SEQ ID NO: 12515 - protein, 10 aa, Homo Sapiens
GGNLPGSSGR

SEQ ID NO: 12516 - protein, 10 aa, Homo Sapiens
VTQVVRDFLH

SEQ ID NO: 12517 - protein, 10 aa, Homo Sapiens
FLHAQKVQPP

SEQ ID NO: 12518 - protein, 10 aa, Homo Sapiens
GFRMLLASPG

SEQ ID NO: 12519 - protein, 10 aa, Homo Sapiens
LLASPGACFK

SEQ ID NO: 12520 - protein, 10 aa, Homo Sapiens
GACFKLFQEK

SEQ ID NO: 12521 - protein, 10 aa, Homo Sapiens
HGRALLFQGV

SEQ ID NO: 12522 - protein, 10 aa, Homo Sapiens
LFQGVVDDEQ

SEQ ID NO: 12523 - protein, 10 aa, Homo Sapiens
FQGVVDDEQV

SEQ ID NO: 12524 - protein, 10 aa, Homo Sapiens
QGVVDDEQVK

SEQ ID NO: 12525 - protein, 10 aa, Homo Sapiens
VDDEQVKTIS

SEQ ID NO: 12526 - protein, 10 aa, Homo Sapiens
QSCIDWNREV

SEQ ID NO: 12527 - protein, 10 aa, Homo Sapiens
LKRELGLAEC

SEQ ID NO: 12528 - protein, 10 aa, Homo Sapiens
DIPQLFKTER

SEQ ID NO: 12529 - protein, 10 aa, Homo Sapiens
FKTERKKATA

SEQ ID NO: 12530 - protein, 10 aa, Homo Sapiens
RKKATAFFPD

SEQ ID NO: 12531 - protein, 10 aa, Homo Sapiens
VLGKHLGIPK

SEQ ID NO: 12532 - protein, 10 aa, Homo Sapiens
HLGIPKPFGP

SEQ ID NO: 12533 - protein, 10 aa, Homo Sapiens
FGPIINGCCC

SEQ ID NO: 12534 - protein, 10 aa, Homo Sapiens
INGCCCLEEK

SEQ ID NO: 12535 - protein, 10 aa, Homo Sapiens
LHCTFIDDFT

SEQ ID NO: 12536 - protein, 10 aa, Homo Sapiens
HCTFIDDFTP

SEQ ID NO: 12537 - protein, 10 aa, Homo Sapiens
PYHMLHGEVH

SEQ ID NO: 12538 - protein, 10 aa, Homo Sapiens
MLHGEVHCGT

SEQ ID NO: 12539 - protein, 10 aa, Homo Sapiens
LHGEVHCGTN

SEQ ID NO: 12540 - protein, 10 aa, Homo Sapiens
RKPFSFKWWN

SEQ ID NO: 12541 - protein, 10 aa, Homo Sapiens
IMTPSTLAPL

SEQ ID NO: 12542 - protein, 10 aa, Homo Sapiens
PSTLAPLEVY

SEQ ID NO: 12543 - protein, 10 aa, Homo Sapiens
WIMTPSTLAP

SEQ ID NO: 12544 - protein, 10 aa, Homo Sapiens
TLAPLEVYVC

SEQ ID NO: 12545 - protein, 10 aa, Homo Sapiens
APLEVYVCRV

SEQ ID NO: 12546 - protein, 10 aa, Homo Sapiens
PWIMTPSTLA

SEQ ID NO: 12547 - protein, 10 aa, Homo Sapiens
TPSTLAPLEV

SEQ ID NO: 12548 - protein, 15 aa, Homo Sapiens
DAGFTGLISFHVTLL

SEQ ID NO: 12549 - protein, 15 aa, Homo Sapiens
DFPYKRILGPDFGYV

SEQ ID NO: 12550 - protein, 15 aa, Homo Sapiens
DMSVMVLRTQGPAAL

SEQ ID NO: 12551 - protein, 15 aa, Homo Sapiens
VETLVDIYGSVPEGT

SEQ ID NO: 12552 - protein, 15 aa, Homo Sapiens
VMVLRTQGPAALFDD

SEQ ID NO: 12553 - protein, 15 aa, Homo Sapiens
YPLGRILIGGNLPGS

SEQ ID NO: 12554 - protein, 15 aa, Homo Sapiens
GKGFRMLLASPGACF

SEQ ID NO: 12555 - protein, 15 aa, Homo Sapiens
AQVFHICGPEDVCEA

SEQ ID NO: 12556 - protein, 15 aa, Homo Sapiens
DTVVFRVAPWIMTPS

SEQ ID NO: 12557 - protein, 15 aa, Homo Sapiens
TEMFEVYGTPGVDIY

SEQ ID NO: 12558 - protein, 15 aa, Homo Sapiens
TRRWRFDATLEIIVV

SEQ ID NO: 12559 - protein, 15 aa, Homo Sapiens
PLAYAVLYLTCVDIS

SEQ ID NO: 12560 - protein, 15 aa, Homo Sapiens
NTCFVDAVAELARKA

SEQ ID NO: 12561 - protein, 15 aa, Homo Sapiens
LDSFGNLEVSPPVVA

SEQ ID NO: 12562 - protein, 15 aa, Homo Sapiens
LSFVPAPDGKGFRML

SEQ ID NO: 12563 - protein, 15 aa, Homo Sapiens
GKHLGIPKPFGPIIN

SEQ ID NO: 12564 - protein, 15 aa, Homo Sapiens
FTPYHMLHGEVHCGT

SEQ ID NO: 12565 - protein, 15 aa, Homo Sapiens
TSSYDAKRAQVFHIC

SEQ ID NO: 12566 - protein, 15 aa, Homo Sapiens
CEAYRHVLGQDKVSY

SEQ ID NO: 12567 - protein, 15 aa, Homo Sapiens
TDTVVFRVAPWIMTP

SEQ ID NO: 12568 - protein, 15 aa, Homo Sapiens
VAPWIMTPSTLPPLE

SEQ ID NO: 12569 - protein, 15 aa, Homo Sapiens
QVVRDFLHAQKVQPP

SEQ ID NO: 12570 - protein, 15 aa, Homo Sapiens
TAFFPDLVNMLVLGK

SEQ ID NO: 12571 - protein, 15 aa, Homo Sapiens
HLGIPKPFGPIINGC

SEQ ID NO: 12572 - protein, 15 aa, Homo Sapiens
EKVRSLLEPLGLHCT

SEQ ID NO: 12573 - protein, 15 aa, Homo Sapiens
TPGVDIYISPNMERG

SEQ ID NO: 12574 - protein, 15 aa, Homo Sapiens
DATLEIIVVMNSPSN

SEQ ID NO: 12575 - protein, 15 aa, Homo Sapiens
VHCLQDLEDMSVMVL

SEQ ID NO: 12576 - protein, 15 aa, Homo Sapiens
VAELARKAGCKLTIC

SEQ ID NO: 12577 - protein, 15 aa, Homo Sapiens
GGNLPGSSGRRVTQV

SEQ ID NO: 12578 - protein, 15 aa, Homo Sapiens
KGFRMLLASPGACFK

SEQ ID NO: 12579 - protein, 15 aa, Homo Sapiens
IVRVSLEHPTSAVCV

SEQ ID NO: 12580 - protein, 15 aa, Homo Sapiens
MFEVYGTPGVDIYIS

SEQ ID NO: 12581 - protein, 15 aa, Homo Sapiens
AYAVLYLTCVDISLD

SEQ ID NO: 12582 - protein, 15 aa, Homo Sapiens
SVMVLRTQGPAALFD

SEQ ID NO: 12583 - protein, 15 aa, Homo Sapiens
SYEVPRLHGDEERFF

SEQ ID NO: 12584 - protein, 15 aa, Homo Sapiens
DEERFFVEGLSFPDA

SEQ ID NO: 12585 - protein, 15 aa, Homo Sapiens
RFFVEGLSFPDAGFT

SEQ ID NO: 12586 - protein, 15 aa, Homo Sapiens
EPRDRSVSGLDSFGN

SEQ ID NO: 12587 - protein, 15 aa, Homo Sapiens
DRSVSGLDSFGNLEV

SEQ ID NO: 12588 - protein, 15 aa, Homo Sapiens
PLGRILIGGNLPGSS

SEQ ID NO: 12589 - protein, 15 aa, Homo Sapiens
ELFVDWLAVGHVDEF

SEQ ID NO: 12590 - protein, 15 aa, Homo Sapiens
FRMLLASPGACFKLF

SEQ ID NO: 12591 - protein, 15 aa, Homo Sapiens
DLVNMLVLGKHLGIP

SEQ ID NO: 12592 - protein, 15 aa, Homo Sapiens
LQRIVRVSLEHPTSA

SEQ ID NO: 12593 - protein, 15 aa, Homo Sapiens
GTEMFEVYGTPGVDI

SEQ ID NO: 12594 - protein, 15 aa, Homo Sapiens
RVAPWIMTPSTLPPL

SEQ ID NO: 12595 - protein, 15 aa, Homo Sapiens
GRRVTQVVRDFLHAQ

SEQ ID NO: 12596 - protein, 15 aa, Homo Sapiens
DEFLSFVPAPDGKGF

SEQ ID NO: 12597 - protein, 15 aa, Homo Sapiens
DEQVKTISINQVLSN

SEQ ID NO: 12598 - protein, 15 aa, Homo Sapiens
TLEIIVVMNSPSNDL

SEQ ID NO: 12599 - protein, 15 aa, Homo Sapiens
IIVVMNSPSNDLNDS

SEQ ID NO: 12600 - protein, 15 aa, Homo Sapiens
HVQISYHSSHEPLPL

SEQ ID NO: 12601 - protein, 15 aa, Homo Sapiens
LQDLEDMSVMVLRTQ

SEQ ID NO: 12602 - protein, 15 aa, Homo Sapiens
HKLVLHTSSYDAKRA

SEQ ID NO: 12603 - protein, 15 aa, Homo Sapiens
RAQVFHICGPEDVCE

SEQ ID NO: 12604 - protein, 15 aa, Homo Sapiens
GLSFPDAGFTGLISF

SEQ ID NO: 12605 - protein, 15 aa, Homo Sapiens
APWIMTPSTLPPLEV

SEQ ID NO: 12606 - protein, 15 aa, Homo Sapiens
IMTPSTLPPLEVYVC

SEQ ID NO: 12607 - protein, 15 aa, Homo Sapiens
EMELGYVQAPHKTLP

SEQ ID NO: 12608 - protein, 15 aa, Homo Sapiens
FGNLEVSPPVVANGK

SEQ ID NO: 12609 - protein, 15 aa, Homo Sapiens
RILIGGNLPGSSGRR

SEQ ID NO: 12610 - protein, 15 aa, Homo Sapiens
RDFLHAQKVQPPVEL

SEQ ID NO: 12611 - protein, 15 aa, Homo Sapiens
WLAVGHVDEFLSFVP

SEQ ID NO: 12612 - protein, 15 aa, Homo Sapiens
VGHVDEFLSFVPAPD

SEQ ID NO: 12613 - protein, 15 aa, Homo Sapiens
TISINQVLSNKDLIN

SEQ ID NO: 12614 - protein, 15 aa, Homo Sapiens
CTFIDDFTPYHMLHG

SEQ ID NO: 12615 - protein, 15 aa, Homo Sapiens
AVCVAGVETLVDIYG

SEQ ID NO: 12616 - protein, 15 aa, Homo Sapiens
LEIIVVMNSPSNDLN

SEQ ID NO: 12617 - protein, 15 aa, Homo Sapiens
QWVWGPSGYGGILLV

SEQ ID NO: 12618 - protein, 15 aa, Homo Sapiens
LHAQKVQPPVELFVD

SEQ ID NO: 12619 - protein, 15 aa, Homo Sapiens
VELFVDWLAVGHVDE

SEQ ID NO: 12620 - protein, 15 aa, Homo Sapiens
LINYNKFVQSCIDWN

SEQ ID NO: 12621 - protein, 15 aa, Homo Sapiens
IPQLFKTERKKATAF

SEQ ID NO: 12622 - protein, 15 aa, Homo Sapiens
LNDSHVQISYHSSHE

SEQ ID NO: 12623 - protein, 15 aa, Homo Sapiens
DFSASPIFTDTVVFR

SEQ ID NO: 12624 - protein, 15 aa, Homo Sapiens
ELGYVQAPHKTLPVV

SEQ ID NO: 12625 - protein, 15 aa, Homo Sapiens
LQDFPYKRILGPDFG

SEQ ID NO: 12626 - protein, 15 aa, Homo Sapiens
FPYKRILGPDFGYVT

SEQ ID NO: 12627 - protein, 15 aa, Homo Sapiens
SFGNLEVSPPVVANG

SEQ ID NO: 12628 - protein, 15 aa, Homo Sapiens
CGHGRALLFQGVVDD

SEQ ID NO: 12629 - protein, 15 aa, Homo Sapiens
VVDDEQVKTISINQV

SEQ ID NO: 12630 - protein, 15 aa, Homo Sapiens
VNMLVLGKHLGIPKP

SEQ ID NO: 12631 - protein, 15 aa, Homo Sapiens
LTCVDISLDCDLNCE

SEQ ID NO: 12632 - protein, 15 aa, Homo Sapiens
EERFFVEGLSFPDAG

SEQ ID NO: 12633 - protein, 15 aa, Homo Sapiens
SPIFTDTVVFRVAPW

SEQ ID NO: 12634 - protein, 15 aa, Homo Sapiens
FVDAVAELARKAGCK

SEQ ID NO: 12635 - protein, 15 aa, Homo Sapiens
DFGYVTREPRDRSVS

SEQ ID NO: 12636 - protein, 15 aa, Homo Sapiens
NREVLKRELGLAECD

SEQ ID NO: 12637 - protein, 15 aa, Homo Sapiens
KTERKKATAFFPDLV

SEQ ID NO: 12638 - protein, 15 aa, Homo Sapiens
PDLVNMLVLGKHLGI

SEQ ID NO: 12639 - protein, 15 aa, Homo Sapiens
LVLGKHLGIPKPFGP

SEQ ID NO: 12640 - protein, 15 aa, Homo Sapiens
RIVRVSLEHPTSAVC

SEQ ID NO: 12641 - protein, 15 aa, Homo Sapiens
AGVETLVDIYGSVPE

SEQ ID NO: 12642 - protein, 15 aa, Homo Sapiens
ETLVDIYGSVPEGTE

SEQ ID NO: 12643 - protein, 15 aa, Homo Sapiens
DIYGSVPEGTEMFEV

SEQ ID NO: 12644 - protein, 15 aa, Homo Sapiens
RWRFDATLEIIVVMN

SEQ ID NO: 12645 - protein, 15 aa, Homo Sapiens
QISYHSSHEPLPLAY

SEQ ID NO: 12646 - protein, 15 aa, Homo Sapiens
AVLYLTCVDISLDCD

SEQ ID NO: 12647 - protein, 15 aa, Homo Sapiens
RQWVWGPSGYGGILL

SEQ ID NO: 12648 - protein, 15 aa, Homo Sapiens
MSVMVLRTQGPAALF

SEQ ID NO: 12649 - protein, 15 aa, Homo Sapiens
LFDDHKLVLHTSSYD

SEQ ID NO: 12650 - protein, 15 aa, Homo Sapiens
EAYRHVLGQDKVSYE

SEQ ID NO: 12651 - protein, 15 aa, Homo Sapiens
VPRLHGDEERFFVEG

SEQ ID NO: 12652 - protein, 15 aa, Homo Sapiens
LISFHVTLLDDSNED

SEQ ID NO: 12653 - protein, 15 aa, Homo Sapiens
SFHVTLLDDSNEDFS

SEQ ID NO: 12654 - protein, 15 aa, Homo Sapiens
PVVFDSPRNGELQDF

SEQ ID NO: 12655 - protein, 15 aa, Homo Sapiens
SPPVVANGKEYPLGR

SEQ ID NO: 12656 - protein, 15 aa, Homo Sapiens
GRILIGGNLPGSSGR

SEQ ID NO: 12657 - protein, 15 aa, Homo Sapiens
VRDFLHAQKVQPPVE

SEQ ID NO: 12658 - protein, 15 aa, Homo Sapiens
QEKQKCGHGRALLFQ

SEQ ID NO: 12659 - protein, 15 aa, Homo Sapiens
KRELGLAECDIIDIP

SEQ ID NO: 12660 - protein, 15 aa, Homo Sapiens
FKTERKKATAFFPDL

SEQ ID NO: 12661 - protein, 15 aa, Homo Sapiens
ATAFFPDLVNMLVLG

SEQ ID NO: 12662 - protein, 15 aa, Homo Sapiens
MLVLGKHLGIPKPFG

SEQ ID NO: 12663 - protein, 15 aa, Homo Sapiens
EEKVRSLLEPLGLHC

SEQ ID NO: 12664 - protein, 15 aa, Homo Sapiens
TSAVCVAGVETLVDI

SEQ ID NO: 12665 - protein, 15 aa, Homo Sapiens
WRFDATLEIIVVMNS

SEQ ID NO: 12666 - protein, 15 aa, Homo Sapiens
ATLEIIVVMNSPSND

SEQ ID NO: 12667 - protein, 15 aa, Homo Sapiens
NSPSNDLNDSHVQIS

SEQ ID NO: 12668 - protein, 15 aa, Homo Sapiens
SNDLNDSHVQISYHS

SEQ ID NO: 12669 - protein, 15 aa, Homo Sapiens
SSHEPLPLAYAVLYL

SEQ ID NO: 12670 - protein, 15 aa, Homo Sapiens
HEPLPLAYAVLYLTC

SEQ ID NO: 12671 - protein, 15 aa, Homo Sapiens
YAVLYLTCVDISLDC

SEQ ID NO: 12672 - protein, 15 aa, Homo Sapiens
NFVDKRQWVWGPSGY

SEQ ID NO: 12673 - protein, 15 aa, Homo Sapiens
KRQWVWGPSGYGGIL

SEQ ID NO: 12674 - protein, 15 aa, Homo Sapiens
VWGPSGYGGILLVNC

SEQ ID NO: 12675 - protein, 15 aa, Homo Sapiens
GILLVNCDRDDPSCD

SEQ ID NO: 12676 - protein, 15 aa, Homo Sapiens
ILLVNCDRDDPSCDV

SEQ ID NO: 12677 - protein, 15 aa, Homo Sapiens
MVLRTQGPAALFDDH

SEQ ID NO: 12678 - protein, 15 aa, Homo Sapiens
FDDHKLVLHTSSYDA

SEQ ID NO: 12679 - protein, 15 aa, Homo Sapiens
VLHTSSYDAKRAQVF

SEQ ID NO: 12680 - protein, 15 aa, Homo Sapiens
ERFFVEGLSFPDAGF

SEQ ID NO: 12681 - protein, 15 aa, Homo Sapiens
VEGLSFPDAGFTGLI

SEQ ID NO: 12682 - protein, 15 aa, Homo Sapiens
FTGLISFHVTLLDDS

SEQ ID NO: 12683 - protein, 15 aa, Homo Sapiens
VFRVAPWIMTPSTLP

SEQ ID NO: 12684 - protein, 15 aa, Homo Sapiens
PWIMTPSTLPPLEVY

SEQ ID NO: 12685 - protein, 15 aa, Homo Sapiens
PSTLPPLEVYVCRVR

SEQ ID NO: 12686 - protein, 15 aa, Homo Sapiens
VDAVAELARKAGCKL

SEQ ID NO: 12687 - protein, 15 aa, Homo Sapiens
RNDRWIQDEMELGYV

SEQ ID NO: 12688 - protein, 15 aa, Homo Sapiens
IQDEMELGYVQAPHK

SEQ ID NO: 12689 - protein, 15 aa, Homo Sapiens
QDEMELGYVQAPHKT

SEQ ID NO: 12690 - protein, 15 aa, Homo Sapiens
LGYVQAPHKTLPVVF

SEQ ID NO: 12691 - protein, 15 aa, Homo Sapiens
TLPVVFDSPRNGELQ

SEQ ID NO: 12692 - protein, 15 aa, Homo Sapiens
NGELQDFPYKRILGP

SEQ ID NO: 12693 - protein, 15 aa, Homo Sapiens
FGYVTREPRDRSVSG

SEQ ID NO: 12694 - protein, 15 aa, Homo Sapiens
VSGLDSFGNLEVSPP

SEQ ID NO: 12695 - protein, 15 aa, Homo Sapiens
ANGKEYPLGRILIGG

SEQ ID NO: 12696 - protein, 15 aa, Homo Sapiens
NGKEYPLGRILIGGN

SEQ ID NO: 12697 - protein, 15 aa, Homo Sapiens
VQPPVELFVDWLAVG

SEQ ID NO: 12698 - protein, 15 aa, Homo Sapiens
QPPVELFVDWLAVGH

SEQ ID NO: 12699 - protein, 15 aa, Homo Sapiens
FVDWLAVGHVDEFLS

SEQ ID NO: 12700 - protein, 15 aa, Homo Sapiens
GHVDEFLSFVPAPDG

SEQ ID NO: 12701 - protein, 15 aa, Homo Sapiens
RMLLASPGACFKLFQ

SEQ ID NO: 12702 - protein, 15 aa, Homo Sapiens
GHGRALLFQGVVDDE

SEQ ID NO: 12703 - protein, 15 aa, Homo Sapiens
QGVVDDEQVKTISIN

SEQ ID NO: 12704 - protein, 15 aa, Homo Sapiens
ISINQVLSNKDLINY

SEQ ID NO: 12705 - protein, 15 aa, Homo Sapiens
KDLINYNKFVQSCID

SEQ ID NO: 12706 - protein, 15 aa, Homo Sapiens
IDWNREVLKRELGLA

SEQ ID NO: 12707 - protein, 15 aa, Homo Sapiens
REVLKRELGLAECDI

SEQ ID NO: 12708 - protein, 15 aa, Homo Sapiens
LAECDIIDIPQLFKT

SEQ ID NO: 12709 - protein, 15 aa, Homo Sapiens
AECDIIDIPQLFKTE

SEQ ID NO: 12710 - protein, 15 aa, Homo Sapiens
IIDIPQLFKTERKKA

SEQ ID NO: 12711 - protein, 15 aa, Homo Sapiens
LFKTERKKATAFFPD

SEQ ID NO: 12712 - protein, 15 aa, Homo Sapiens
FPDLVNMLVLGKHLG

SEQ ID NO: 12713 - protein, 15 aa, Homo Sapiens
LVNMLVLGKHLGIPK

SEQ ID NO: 12714 - protein, 15 aa, Homo Sapiens
KPFGPIINGCCCLEE

SEQ ID NO: 12715 - protein, 15 aa, Homo Sapiens
RSLLEPLGLHCTFID

SEQ ID NO: 12716 - protein, 15 aa, Homo Sapiens
LLEPLGLHCTFIDDF

SEQ ID NO: 12717 - protein, 15 aa, Homo Sapiens
MLHGEVHCGTNVCRK

SEQ ID NO: 12718 - protein, 15 aa, Homo Sapiens
VSLEHPTSAVCVAGV

SEQ ID NO: 12719 - protein, 15 aa, Homo Sapiens
EHPTSAVCVAGVETL

SEQ ID NO: 12720 - protein, 15 aa, Homo Sapiens
VAGVETLVDIYGSVP

SEQ ID NO: 12721 - protein, 15 aa, Homo Sapiens
LVDIYGSVPEGTEMF

SEQ ID NO: 12722 - protein, 15 aa, Homo Sapiens
VDIYGSVPEGTEMFE

SEQ ID NO: 12723 - protein, 15 aa, Homo Sapiens
IYGSVPEGTEMFEVY

SEQ ID NO: 12724 - protein, 15 aa, Homo Sapiens
EIIVVMNSPSNDLND

SEQ ID NO: 12725 - protein, 15 aa, Homo Sapiens
HSSHEPLPLAYAVLY

SEQ ID NO: 12726 - protein, 15 aa, Homo Sapiens
SHEPLPLAYAVLYLT

SEQ ID NO: 12727 - protein, 15 aa, Homo Sapiens
WVWGPSGYGGILLVN

SEQ ID NO: 12728 - protein, 15 aa, Homo Sapiens
PSGYGGILLVNCDRD

SEQ ID NO: 12729 - protein, 15 aa, Homo Sapiens
VNCDRDDPSCDVQDN

SEQ ID NO: 12730 - protein, 15 aa, Homo Sapiens
SCDVQDNCDQHVHCL

SEQ ID NO: 12731 - protein, 15 aa, Homo Sapiens
DQHVHCLQDLEDMSV

SEQ ID NO: 12732 - protein, 15 aa, Homo Sapiens
PAALFDDHKLVLHTS

SEQ ID NO: 12733 - protein, 15 aa, Homo Sapiens
DHKLVLHTSSYDAKR

SEQ ID NO: 12734 - protein, 15 aa, Homo Sapiens
PEDVCEAYRHVLGQD

SEQ ID NO: 12735 - protein, 15 aa, Homo Sapiens
VLGQDKVSYEVPRLH

SEQ ID NO: 12736 - protein, 15 aa, Homo Sapiens
SFPDAGFTGLISFHV

SEQ ID NO: 12737 - protein, 15 aa, Homo Sapiens
HVTLLDDSNEDFSAS

SEQ ID NO: 12738 - protein, 15 aa, Homo Sapiens
VTLLDDSNEDFSASP

SEQ ID NO: 12739 - protein, 15 aa, Homo Sapiens
DDSNEDFSASPIFTD

SEQ ID NO: 12740 - protein, 15 aa, Homo Sapiens
VQAPHKTLPVVFDSP

SEQ ID NO: 12741 - protein, 15 aa, Homo Sapiens
YKRILGPDFGYVTRE

SEQ ID NO: 12742 - protein, 15 aa, Homo Sapiens
KRILGPDFGYVTREP

SEQ ID NO: 12743 - protein, 15 aa, Homo Sapiens
GPDFGYVTREPRDRS

SEQ ID NO: 12744 - protein, 15 aa, Homo Sapiens
DSFGNLEVSPPVVAN

SEQ ID NO: 12745 - protein, 15 aa, Homo Sapiens
LEVSPPVVANGKEYP

SEQ ID NO: 12746 - protein, 15 aa, Homo Sapiens
PPVVANGKEYPLGRI

SEQ ID NO: 12747 - protein, 15 aa, Homo Sapiens
EYPLGRILIGGNLPG

SEQ ID NO: 12748 - protein, 15 aa, Homo Sapiens
ILIGGNLPGSSGRRV

SEQ ID NO: 12749 - protein, 15 aa, Homo Sapiens
SGRRVTQVVRDFLHA

SEQ ID NO: 12750 - protein, 15 aa, Homo Sapiens
AQKVQPPVELFVDWL

SEQ ID NO: 12751 - protein, 15 aa, Homo Sapiens
VDWLAVGHVDEFLSF

SEQ ID NO: 12752 - protein, 15 aa, Homo Sapiens
VDEFLSFVPAPDGKG

SEQ ID NO: 12753 - protein, 15 aa, Homo Sapiens
FVPAPDGKGFRMLLA

SEQ ID NO: 12754 - protein, 15 aa, Homo Sapiens
KQKCGHGRALLFQGV

SEQ ID NO: 12755 - protein, 15 aa, Homo Sapiens
GRALLFQGVVDDEQV

SEQ ID NO: 12756 - protein, 15 aa, Homo Sapiens
ALLFQGVVDDEQVKT

SEQ ID NO: 12757 - protein, 15 aa, Homo Sapiens
LSNKDLINYNKFVQS

SEQ ID NO: 12758 - protein, 15 aa, Homo Sapiens
LKRELGLAECDIIDI

SEQ ID NO: 12759 - protein, 15 aa, Homo Sapiens
ELGLAECDIIDIPQL

SEQ ID NO: 12760 - protein, 15 aa, Homo Sapiens
NMLVLGKHLGIPKPF

SEQ ID NO: 12761 - protein, 15 aa, Homo Sapiens
VLGKHLGIPKPFGPI

SEQ ID NO: 12762 - protein, 15 aa, Homo Sapiens
PKPFGPIINGCCCLE

SEQ ID NO: 12763 - protein, 15 aa, Homo Sapiens
CCCLEEKVRSLLEPL

SEQ ID NO: 12764 - protein, 15 aa, Homo Sapiens
VRSLLEPLGLHCTFI

SEQ ID NO: 12765 - protein, 15 aa, Homo Sapiens
PLGLHCTFIDDFTPY

SEQ ID NO: 12766 - protein, 15 aa, Homo Sapiens
GLHCTFIDDFTPYHM

SEQ ID NO: 12767 - protein, 15 aa, Homo Sapiens
HCTFIDDFTPYHMLH

SEQ ID NO: 12768 - protein, 15 aa, Homo Sapiens
VHCGTNVCRKPFSFK

SEQ ID NO: 12769 - protein, 15 aa, Homo Sapiens
PTSAVCVAGVETLVD

SEQ ID NO: 12770 - protein, 15 aa, Homo Sapiens
NDSHVQISYHSSHEP

SEQ ID NO: 12771 - protein, 15 aa, Homo Sapiens
ISYHSSHEPLPLAYA

SEQ ID NO: 12772 - protein, 15 aa, Homo Sapiens
VLYLTCVDISLDCDL

SEQ ID NO: 12773 - protein, 15 aa, Homo Sapiens
YGGILLVNCDRDDPS

SEQ ID NO: 12774 - protein, 15 aa, Homo Sapiens
QHVHCLQDLEDMSVM

SEQ ID NO: 12775 - protein, 15 aa, Homo Sapiens
LEDMSVMVLRTQGPA

SEQ ID NO: 12776 - protein, 15 aa, Homo Sapiens
QDKVSYEVPRLHGDE

SEQ ID NO: 12777 - protein, 15 aa, Homo Sapiens
TGLISFHVTLLDDSN

SEQ ID NO: 12778 - protein, 15 aa, Homo Sapiens
LDDSNEDFSASPIFT

SEQ ID NO: 12779 - protein, 15 aa, Homo Sapiens
DSNEDFSASPIFTDT

SEQ ID NO: 12780 - protein, 15 aa, Homo Sapiens
SASPIFTDTVVFRVA

SEQ ID NO: 12781 - protein, 15 aa, Homo Sapiens
PIFTDTVVFRVAPWI

SEQ ID NO: 12782 - protein, 15 aa, Homo Sapiens
IFTDTVVFRVAPWIM

SEQ ID NO: 12783 - protein, 15 aa, Homo Sapiens
YVCRVRNNTCFVDAV

SEQ ID NO: 12784 - protein, 15 aa, Homo Sapiens
RNNTCFVDAVAELAR

SEQ ID NO: 12785 - protein, 15 aa, Homo Sapiens
RWIQDEMELGYVQAP

SEQ ID NO: 12786 - protein, 15 aa, Homo Sapiens
LGPDFGYVTREPRDR

SEQ ID NO: 12787 - protein, 15 aa, Homo Sapiens
PPVELFVDWLAVGHV

SEQ ID NO: 12788 - protein, 15 aa, Homo Sapiens
GFRMLLASPGACFKL

SEQ ID NO: 12789 - protein, 15 aa, Homo Sapiens
GVVDDEQVKTISINQ

SEQ ID NO: 12790 - protein, 15 aa, Homo Sapiens
RKKATAFFPDLVNML

SEQ ID NO: 12791 - protein, 15 aa, Homo Sapiens
AFFPDLVNMLVLGKH

SEQ ID NO: 12792 - protein, 15 aa, Homo Sapiens
LEPLGLHCTFIDDFT

SEQ ID NO: 12793 - protein, 15 aa, Homo Sapiens
CGTNVCRKPFSFKWW

SEQ ID NO: 12794 - protein, 15 aa, Homo Sapiens
VRVSLEHPTSAVCVA

SEQ ID NO: 12795 - protein, 15 aa, Homo Sapiens
RVSLEHPTSAVCVAG

SEQ ID NO: 12796 - protein, 15 aa, Homo Sapiens
VYGTPGVDIYISPNM

SEQ ID NO: 12797 - protein, 15 aa, Homo Sapiens
LNCEGRQDRNFVDKR

SEQ ID NO: 12798 - protein, 15 aa, Homo Sapiens
VDKRQWVWGPSGYGG

SEQ ID NO: 12799 - protein, 15 aa, Homo Sapiens
VQDNCDQHVHCLQDL

SEQ ID NO: 12800 - protein, 15 aa, Homo Sapiens
CLQDLEDMSVMVLRT

SEQ ID NO: 12801 - protein, 15 aa, Homo Sapiens
DDHKLVLHTSSYDAK

SEQ ID NO: 12802 - protein, 15 aa, Homo Sapiens
YRHVLGQDKVSYEVP

SEQ ID NO: 12803 - protein, 15 aa, Homo Sapiens
HVLGQDKVSYEVPRL

SEQ ID NO: 12804 - protein, 15 aa, Homo Sapiens
LSFPDAGFTGLISFH

SEQ ID NO: 12805 - protein, 15 aa, Homo Sapiens
TLPPLEVYVCRVRNN

SEQ ID NO: 12806 - protein, 15 aa, Homo Sapiens
EVYVCRVRNNTCFVD

SEQ ID NO: 12807 - protein, 15 aa, Homo Sapiens
TCFVDAVAELARKAG

SEQ ID NO: 12808 - protein, 15 aa, Homo Sapiens
ARKAGCKLTICPQAE

SEQ ID NO: 12809 - protein, 15 aa, Homo Sapiens
KLTICPQAENRNDRW

SEQ ID NO: 12810 - protein, 15 aa, Homo Sapiens
GYVQAPHKTLPVVFD

SEQ ID NO: 12811 - protein, 15 aa, Homo Sapiens
PHKTLPVVFDSPRNG

SEQ ID NO: 12812 - protein, 15 aa, Homo Sapiens
HKTLPVVFDSPRNGE

SEQ ID NO: 12813 - protein, 15 aa, Homo Sapiens
PGSSGRRVTQVVRDF

SEQ ID NO: 12814 - protein, 15 aa, Homo Sapiens
FLHAQKVQPPVELFV

SEQ ID NO: 12815 - protein, 15 aa, Homo Sapiens
DGKGFRMLLASPGAC

SEQ ID NO: 12816 - protein, 15 aa, Homo Sapiens
LLFQGVVDDEQVKTI

SEQ ID NO: 12817 - protein, 15 aa, Homo Sapiens
QVKTISINQVLSNKD

SEQ ID NO: 12818 - protein, 15 aa, Homo Sapiens
INYNKFVQSCIDWNR

SEQ ID NO: 12819 - protein, 15 aa, Homo Sapiens
ECDIIDIPQLFKTER

SEQ ID NO: 12820 - protein, 15 aa, Homo Sapiens
CCLEEKVRSLLEPLG

SEQ ID NO: 12821 - protein, 15 aa, Homo Sapiens
DFTPYHMLHGEVHCG

SEQ ID NO: 12822 - protein, 15 aa, Homo Sapiens
MELGYVQAPHKTLPV

SEQ ID NO: 12823 - protein, 15 aa, Homo Sapiens
GACFKLFQEKQKCGH

SEQ ID NO: 12824 - protein, 15 aa, Homo Sapiens
PGVDIYISPNMERGR

SEQ ID NO: 12825 - protein, 15 aa, Homo Sapiens
KVSYEVPRLHGDEER

SEQ ID NO: 12826 - protein, 15 aa, Homo Sapiens
FSASPIFTDTVVFRV

SEQ ID NO: 12827 - protein, 15 aa, Homo Sapiens
TVVFRVAPWIMTPST

SEQ ID NO: 12828 - protein, 15 aa, Homo Sapiens
FRVAPWIMTPSTLPP

SEQ ID NO: 12829 - protein, 15 aa, Homo Sapiens
AGCKLTICPQAENRN

SEQ ID NO: 12830 - protein, 15 aa, Homo Sapiens
GCKLTICPQAENRND

SEQ ID NO: 12831 - protein, 15 aa, Homo Sapiens
TREPRDRSVSGLDSF

SEQ ID NO: 12832 - protein, 15 aa, Homo Sapiens
LGRILIGGNLPGSSG

SEQ ID NO: 12833 - protein, 15 aa, Homo Sapiens
FLSFVPAPDGKGFRM

SEQ ID NO: 12834 - protein, 15 aa, Homo Sapiens
FKLFQEKQKCGHGRA

SEQ ID NO: 12835 - protein, 15 aa, Homo Sapiens
EQVKTISINQVLSNK

SEQ ID NO: 12836 - protein, 15 aa, Homo Sapiens
SNKDLINYNKFVQSC

SEQ ID NO: 12837 - protein, 15 aa, Homo Sapiens
FVQSCIDWNREVLKR

SEQ ID NO: 12838 - protein, 15 aa, Homo Sapiens
CIDWNREVLKRELGL

SEQ ID NO: 12839 - protein, 15 aa, Homo Sapiens
WNREVLKRELGLAEC

SEQ ID NO: 12840 - protein, 15 aa, Homo Sapiens
CDIIDIPQLFKTERK

SEQ ID NO: 12841 - protein, 15 aa, Homo Sapiens
PQLFKTERKKATAFF

SEQ ID NO: 12842 - protein, 15 aa, Homo Sapiens
PFGPIINGCCCLEEK

SEQ ID NO: 12843 - protein, 15 aa, Homo Sapiens
MSLQRIVRVSLEHPT

SEQ ID NO: 12844 - protein, 15 aa, Homo Sapiens
FEVYGTPGVDIYISP

SEQ ID NO: 12845 - protein, 15 aa, Homo Sapiens
GVDIYISPNMERGRE

SEQ ID NO: 12846 - protein, 15 aa, Homo Sapiens
DIYISPNMERGRERA

SEQ ID NO: 12847 - protein, 15 aa, Homo Sapiens
YISPNMERGRERADT

SEQ ID NO: 12848 - protein, 15 aa, Homo Sapiens
DSHVQISYHSSHEPL

SEQ ID NO: 12849 - protein, 15 aa, Homo Sapiens
DRNFVDKRQWVWGPS

SEQ ID NO: 12850 - protein, 15 aa, Homo Sapiens
SGYGGILLVNCDRDD

SEQ ID NO: 12851 - protein, 15 aa, Homo Sapiens
AYRHVLGQDKVSYEV

SEQ ID NO: 12852 - protein, 15 aa, Homo Sapiens
GDEERFFVEGLSFPD

SEQ ID NO: 12853 - protein, 15 aa, Homo Sapiens
GFTGLISFHVTLLDD

SEQ ID NO: 12854 - protein, 15 aa, Homo Sapiens
LEVYVCRVRNNTCFV

SEQ ID NO: 12855 - protein, 15 aa, Homo Sapiens
VYVCRVRNNTCFVDA

SEQ ID NO: 12856 - protein, 15 aa, Homo Sapiens
NDRWIQDEMELGYVQ

SEQ ID NO: 12857 - protein, 15 aa, Homo Sapiens
FDSPRNGELQDFPYK

SEQ ID NO: 12858 - protein, 15 aa, Homo Sapiens
GYVTREPRDRSVSGL

SEQ ID NO: 12859 - protein, 15 aa, Homo Sapiens
GKEYPLGRILIGGNL

SEQ ID NO: 12860 - protein, 15 aa, Homo Sapiens
LIGGNLPGSSGRRVT

SEQ ID NO: 12861 - protein, 15 aa, Homo Sapiens
PGACFKLFQEKQKCG

SEQ ID NO: 12862 - protein, 15 aa, Homo Sapiens
LFQEKQKCGHGRALL

SEQ ID NO: 12863 - protein, 15 aa, Homo Sapiens
FQEKQKCGHGRALLF

SEQ ID NO: 12864 - protein, 15 aa, Homo Sapiens
FQGVVDDEQVKTISI

SEQ ID NO: 12865 - protein, 15 aa, Homo Sapiens
VKTISINQVLSNKDL

SEQ ID NO: 12866 - protein, 15 aa, Homo Sapiens
YNKFVQSCIDWNREV

SEQ ID NO: 12867 - protein, 15 aa, Homo Sapiens
EVLKRELGLAECDII

SEQ ID NO: 12868 - protein, 15 aa, Homo Sapiens
IDDFTPYHMLHGEVH

SEQ ID NO: 12869 - protein, 15 aa, Homo Sapiens
TNVCRKPFSFKWWNM

SEQ ID NO: 12870 - protein, 15 aa, Homo Sapiens
QRIVRVSLEHPTSAV

SEQ ID NO: 12871 - protein, 15 aa, Homo Sapiens
SAVCVAGVETLVDIY

SEQ ID NO: 12872 - protein, 15 aa, Homo Sapiens
VDIYISPNMERGRER

SEQ ID NO: 12873 - protein, 15 aa, Homo Sapiens
ADTRRWRFDATLEII

SEQ ID NO: 12874 - protein, 15 aa, Homo Sapiens
RFDATLEIIVVMNSP

SEQ ID NO: 12875 - protein, 15 aa, Homo Sapiens
ISLDCDLNCEGRQDR

SEQ ID NO: 12876 - protein, 15 aa, Homo Sapiens
LDCDLNCEGRQDRNF

SEQ ID NO: 12877 - protein, 15 aa, Homo Sapiens
DCDLNCEGRQDRNFV

SEQ ID NO: 12878 - protein, 15 aa, Homo Sapiens
RNFVDKRQWVWGPSG

SEQ ID NO: 12879 - protein, 15 aa, Homo Sapiens
FVDKRQWVWGPSGYG

SEQ ID NO: 12880 - protein, 15 aa, Homo Sapiens
QGPAALFDDHKLVLH

SEQ ID NO: 12881 - protein, 15 aa, Homo Sapiens
GPAALFDDHKLVLHT

SEQ ID NO: 12882 - protein, 15 aa, Homo Sapiens
AALFDDHKLVLHTSS

SEQ ID NO: 12883 - protein, 15 aa, Homo Sapiens
AKRAQVFHICGPEDV

SEQ ID NO: 12884 - protein, 15 aa, Homo Sapiens
GPEDVCEAYRHVLGQ

SEQ ID NO: 12885 - protein, 15 aa, Homo Sapiens
GQDKVSYEVPRLHGD

SEQ ID NO: 12886 - protein, 15 aa, Homo Sapiens
HGDEERFFVEGLSFP

SEQ ID NO: 12887 - protein, 15 aa, Homo Sapiens
FVEGLSFPDAGFTGL

SEQ ID NO: 12888 - protein, 15 aa, Homo Sapiens
FPDAGFTGLISFHVT

SEQ ID NO: 12889 - protein, 15 aa, Homo Sapiens
NEDFSASPIFTDTVV

SEQ ID NO: 12890 - protein, 15 aa, Homo Sapiens
VCRVRNNTCFVDAVA

SEQ ID NO: 12891 - protein, 15 aa, Homo Sapiens
RKAGCKLTICPQAEN

SEQ ID NO: 12892 - protein, 15 aa, Homo Sapiens
KAGCKLTICPQAENR

SEQ ID NO: 12893 - protein, 15 aa, Homo Sapiens
DRWIQDEMELGYVQA

SEQ ID NO: 12894 - protein, 15 aa, Homo Sapiens
APHKTLPVVFDSPRN

SEQ ID NO: 12895 - protein, 15 aa, Homo Sapiens
LPVVFDSPRNGELQD

SEQ ID NO: 12896 - protein, 15 aa, Homo Sapiens
GELQDFPYKRILGPD

SEQ ID NO: 12897 - protein, 15 aa, Homo Sapiens
VSPPVVANGKEYPLG

SEQ ID NO: 12898 - protein, 15 aa, Homo Sapiens
VVANGKEYPLGRILI

SEQ ID NO: 12899 - protein, 15 aa, Homo Sapiens
TQVVRDFLHAQKVQP

SEQ ID NO: 12900 - protein, 15 aa, Homo Sapiens
VPAPDGKGFRMLLAS

SEQ ID NO: 12901 - protein, 15 aa, Homo Sapiens
PAPDGKGFRMLLASP

SEQ ID NO: 12902 - protein, 15 aa, Homo Sapiens
SINQVLSNKDLINYN

SEQ ID NO: 12903 - protein, 15 aa, Homo Sapiens
INGCCCLEEKVRSLL

SEQ ID NO: 12904 - protein, 15 aa, Homo Sapiens
NGCCCLEEKVRSLLE

SEQ ID NO: 12905 - protein, 15 aa, Homo Sapiens
YHMLHGEVHCGTNVC

SEQ ID NO: 12906 - protein, 15 aa, Homo Sapiens
EVHCGTNVCRKPFSF

SEQ ID NO: 12907 - protein, 15 aa, Homo Sapiens
GSVPEGTEMFEVYGT

SEQ ID NO: 12908 - protein, 15 aa, Homo Sapiens
EGTEMFEVYGTPGVD

SEQ ID NO: 12909 - protein, 15 aa, Homo Sapiens
EVYGTPGVDIYISPN

SEQ ID NO: 12910 - protein, 15 aa, Homo Sapiens
ISPNMERGRERADTR

SEQ ID NO: 12911 - protein, 15 aa, Homo Sapiens
SPNMERGRERADTRR

SEQ ID NO: 12912 - protein, 15 aa, Homo Sapiens
ERADTRRWRFDATLE

SEQ ID NO: 12913 - protein, 15 aa, Homo Sapiens
DTRRWRFDATLEIIV

SEQ ID NO: 12914 - protein, 15 aa, Homo Sapiens
IVVMNSPSNDLNDSH

SEQ ID NO: 12915 - protein, 15 aa, Homo Sapiens
CVDISLDCDLNCEGR

SEQ ID NO: 12916 - protein, 15 aa, Homo Sapiens
DLNCEGRQDRNFVDK

SEQ ID NO: 12917 - protein, 15 aa, Homo Sapiens
RQDRNFVDKRQWVWG

SEQ ID NO: 12918 - protein, 15 aa, Homo Sapiens
DKRQWVWGPSGYGGI

SEQ ID NO: 12919 - protein, 15 aa, Homo Sapiens
WGPSGYGGILLVNCD

SEQ ID NO: 12920 - protein, 15 aa, Homo Sapiens
GYGGILLVNCDRDDP

SEQ ID NO: 12921 - protein, 15 aa, Homo Sapiens
GGILLVNCDRDDPSC

SEQ ID NO: 12922 - protein, 15 aa, Homo Sapiens
HCLQDLEDMSVMVLR

SEQ ID NO: 12923 - protein, 15 aa, Homo Sapiens
EDMSVMVLRTQGPAA

SEQ ID NO: 12924 - protein, 15 aa, Homo Sapiens
SYDAKRAQVFHICGP

SEQ ID NO: 12925 - protein, 15 aa, Homo Sapiens
VFHICGPEDVCEAYR

SEQ ID NO: 12926 - protein, 15 aa, Homo Sapiens
CGPEDVCEAYRHVLG

SEQ ID NO: 12927 - protein, 15 aa, Homo Sapiens
PRLHGDEERFFVEGL

SEQ ID NO: 12928 - protein, 15 aa, Homo Sapiens
ISFHVTLLDDSNEDF

SEQ ID NO: 12929 - protein, 15 aa, Homo Sapiens
TLLDDSNEDFSASPI

SEQ ID NO: 12930 - protein, 15 aa, Homo Sapiens
VVFRVAPWIMTPSTL

SEQ ID NO: 12931 - protein, 15 aa, Homo Sapiens
LPPLEVYVCRVRNNT

SEQ ID NO: 12932 - protein, 15 aa, Homo Sapiens
PLEVYVCRVRNNTCF

SEQ ID NO: 12933 - protein, 15 aa, Homo Sapiens
CRVRNNTCFVDAVAE

SEQ ID NO: 12934 - protein, 15 aa, Homo Sapiens
RVRNNTCFVDAVAEL

SEQ ID NO: 12935 - protein, 15 aa, Homo Sapiens
VRNNTCFVDAVAELA

SEQ ID NO: 12936 - protein, 15 aa, Homo Sapiens
ELARKAGCKLTICPQ

SEQ ID NO: 12937 - protein, 15 aa, Homo Sapiens
CPQAENRNDRWIQDE

SEQ ID NO: 12938 - protein, 15 aa, Homo Sapiens
WIQDEMELGYVQAPH

SEQ ID NO: 12939 - protein, 15 aa, Homo Sapiens
QAPHKTLPVVFDSPR

SEQ ID NO: 12940 - protein, 15 aa, Homo Sapiens
DSPRNGELQDFPYKR

SEQ ID NO: 12941 - protein, 15 aa, Homo Sapiens
PRDRSVSGLDSFGNL

SEQ ID NO: 12942 - protein, 15 aa, Homo Sapiens
RSVSGLDSFGNLEVS

SEQ ID NO: 12943 - protein, 15 aa, Homo Sapiens
SGLDSFGNLEVSPPV

SEQ ID NO: 12944 - protein, 15 aa, Homo Sapiens
VANGKEYPLGRILIG

SEQ ID NO: 12945 - protein, 15 aa, Homo Sapiens
LPGSSGRRVTQVVRD

SEQ ID NO: 12946 - protein, 15 aa, Homo Sapiens
RVTQVVRDFLHAQKV

SEQ ID NO: 12947 - protein, 15 aa, Homo Sapiens
VTQVVRDFLHAQKVQ

SEQ ID NO: 12948 - protein, 15 aa, Homo Sapiens
HAQKVQPPVELFVDW

SEQ ID NO: 12949 - protein, 15 aa, Homo Sapiens
LFVDWLAVGHVDEFL

SEQ ID NO: 12950 - protein, 15 aa, Homo Sapiens
DWLAVGHVDEFLSFV

SEQ ID NO: 12951 - protein, 15 aa, Homo Sapiens
LAVGHVDEFLSFVPA

SEQ ID NO: 12952 - protein, 15 aa, Homo Sapiens
AVGHVDEFLSFVPAP

SEQ ID NO: 12953 - protein, 15 aa, Homo Sapiens
HVDEFLSFVPAPDGK

SEQ ID NO: 12954 - protein, 15 aa, Homo Sapiens
APDGKGFRMLLASPG

SEQ ID NO: 12955 - protein, 15 aa, Homo Sapiens
PDGKGFRMLLASPGA

SEQ ID NO: 12956 - protein, 15 aa, Homo Sapiens
MLLASPGACFKLFQE

SEQ ID NO: 12957 - protein, 15 aa, Homo Sapiens
LLASPGACFKLFQEK

SEQ ID NO: 12958 - protein, 15 aa, Homo Sapiens
ACFKLFQEKQKCGHG

SEQ ID NO: 12959 - protein, 15 aa, Homo Sapiens
CFKLFQEKQKCGHGR

SEQ ID NO: 12960 - protein, 15 aa, Homo Sapiens
EKQKCGHGRALLFQG

SEQ ID NO: 12961 - protein, 15 aa, Homo Sapiens
HGRALLFQGVVDDEQ

SEQ ID NO: 12962 - protein, 15 aa, Homo Sapiens
DDEQVKTISINQVLS

SEQ ID NO: 12963 - protein, 15 aa, Homo Sapiens
VLSNKDLINYNKFVQ

SEQ ID NO: 12964 - protein, 15 aa, Homo Sapiens
VLKRELGLAECDIID

SEQ ID NO: 12965 - protein, 15 aa, Homo Sapiens
QLFKTERKKATAFFP

SEQ ID NO: 12966 - protein, 15 aa, Homo Sapiens
KATAFFPDLVNMLVL

SEQ ID NO: 12967 - protein, 15 aa, Homo Sapiens
GPIINGCCCLEEKVR

SEQ ID NO: 12968 - protein, 15 aa, Homo Sapiens
IINGCCCLEEKVRSL

SEQ ID NO: 12969 - protein, 15 aa, Homo Sapiens
GCCCLEEKVRSLLEP

SEQ ID NO: 12970 - protein, 15 aa, Homo Sapiens
CLEEKVRSLLEPLGL

SEQ ID NO: 12971 - protein, 15 aa, Homo Sapiens
LEEKVRSLLEPLGLH

SEQ ID NO: 12972 - protein, 15 aa, Homo Sapiens
SLLEPLGLHCTFIDD

SEQ ID NO: 12973 - protein, 15 aa, Homo Sapiens
TFIDDFTPYHMLHGE

SEQ ID NO: 12974 - protein, 15 aa, Homo Sapiens
PYHMLHGEVHCGTNV

SEQ ID NO: 12975 - protein, 15 aa, Homo Sapiens
HCGTNVCRKPFSFKW

SEQ ID NO: 12976 - protein, 15 aa, Homo Sapiens
SLEHPTSAVCVAGVE

SEQ ID NO: 12977 - protein, 15 aa, Homo Sapiens
HPTSAVCVAGVETLV

SEQ ID NO: 12978 - protein, 15 aa, Homo Sapiens
VCVAGVETLVDIYGS

SEQ ID NO: 12979 - protein, 15 aa, Homo Sapiens
GVETLVDIYGSVPEG

SEQ ID NO: 12980 - protein, 15 aa, Homo Sapiens
YGSVPEGTEMFEVYG

SEQ ID NO: 12981 - protein, 15 aa, Homo Sapiens
YGTPGVDIYISPNME

SEQ ID NO: 12982 - protein, 15 aa, Homo Sapiens
NMERGRERADTRRWR

SEQ ID NO: 12983 - protein, 15 aa, Homo Sapiens
GRERADTRRWRFDAT

SEQ ID NO: 12984 - protein, 15 aa, Homo Sapiens
RRWRFDATLEIIVVM

SEQ ID NO: 12985 - protein, 15 aa, Homo Sapiens
VMNSPSNDLNDSHVQ

SEQ ID NO: 12986 - protein, 15 aa, Homo Sapiens
PSNDLNDSHVQISYH

SEQ ID NO: 12987 - protein, 15 aa, Homo Sapiens
VQISYHSSHEPLPLA

SEQ ID NO: 12988 - protein, 15 aa, Homo Sapiens
SYHSSHEPLPLAYAV

SEQ ID NO: 12989 - protein, 15 aa, Homo Sapiens
EPLPLAYAVLYLTCV

SEQ ID NO: 12990 - protein, 15 aa, Homo Sapiens
PLPLAYAVLYLTCVD

SEQ ID NO: 12991 - protein, 15 aa, Homo Sapiens
LAYAVLYLTCVDISL

SEQ ID NO: 12992 - protein, 15 aa, Homo Sapiens
TCVDISLDCDLNCEG

SEQ ID NO: 12993 - protein, 15 aa, Homo Sapiens
DISLDCDLNCEGRQD

SEQ ID NO: 12994 - protein, 15 aa, Homo Sapiens
QDRNFVDKRQWVWGP

SEQ ID NO: 12995 - protein, 15 aa, Homo Sapiens
NCDQHVHCLQDLEDM

SEQ ID NO: 12996 - protein, 15 aa, Homo Sapiens
HVHCLQDLEDMSVMV

SEQ ID NO: 12997 - protein, 15 aa, Homo Sapiens
VLRTQGPAALFDDHK

SEQ ID NO: 12998 - protein, 15 aa, Homo Sapiens
TQGPAALFDDHKLVL

SEQ ID NO: 12999 - protein, 15 aa, Homo Sapiens
KLVLHTSSYDAKRAQ

SEQ ID NO: 13000 - protein, 15 aa, Homo Sapiens
HTSSYDAKRAQVFHI

SEQ ID NO: 13001 - protein, 15 aa, Homo Sapiens
YDAKRAQVFHICGPE

SEQ ID NO: 13002 - protein, 15 aa, Homo Sapiens
FHICGPEDVCEAYRH

SEQ ID NO: 13003 - protein, 15 aa, Homo Sapiens
RHVLGQDKVSYEVPR

SEQ ID NO: 13004 - protein, 15 aa, Homo Sapiens
EVPRLHGDEERFFVE

SEQ ID NO: 13005 - protein, 15 aa, Homo Sapiens
EGLSFPDAGFTGLIS

SEQ ID NO: 13006 - protein, 15 aa, Homo Sapiens
LLDDSNEDFSASPIF

SEQ ID NO: 13007 - protein, 15 aa, Homo Sapiens
ASPIFTDTVVFRVAP

SEQ ID NO: 13008 - protein, 15 aa, Homo Sapiens
TPSTLPPLEVYVCRV

SEQ ID NO: 13009 - protein, 15 aa, Homo Sapiens
NNTCFVDAVAELARK

SEQ ID NO: 13010 - protein, 15 aa, Homo Sapiens
AVAELARKAGCKLTI

SEQ ID NO: 13011 - protein, 15 aa, Homo Sapiens
CKLTICPQAENRNDR

SEQ ID NO: 13012 - protein, 15 aa, Homo Sapiens
ENRNDRWIQDEMELG

SEQ ID NO: 13013 - protein, 15 aa, Homo Sapiens
NRNDRWIQDEMELGY

SEQ ID NO: 13014 - protein, 15 aa, Homo Sapiens
YVQAPHKTLPVVFDS

SEQ ID NO: 13015 - protein, 15 aa, Homo Sapiens
VVFDSPRNGELQDFP

SEQ ID NO: 13016 - protein, 15 aa, Homo Sapiens
SPRNGELQDFPYKRI

SEQ ID NO: 13017 - protein, 15 aa, Homo Sapiens
YVTREPRDRSVSGLD

SEQ ID NO: 13018 - protein, 15 aa, Homo Sapiens
SVSGLDSFGNLEVSP

SEQ ID NO: 13019 - protein, 15 aa, Homo Sapiens
GLDSFGNLEVSPPVV

SEQ ID NO: 13020 - protein, 15 aa, Homo Sapiens
NLEVSPPVVANGKEY

SEQ ID NO: 13021 - protein, 15 aa, Homo Sapiens
GSSGRRVTQVVRDFL

SEQ ID NO: 13022 - protein, 15 aa, Homo Sapiens
DFLHAQKVQPPVELF

SEQ ID NO: 13023 - protein, 15 aa, Homo Sapiens
PVELFVDWLAVGHVD

SEQ ID NO: 13024 - protein, 15 aa, Homo Sapiens
EFLSFVPAPDGKGFR

SEQ ID NO: 13025 - protein, 15 aa, Homo Sapiens
KLFQEKQKCGHGRAL

SEQ ID NO: 13026 - protein, 15 aa, Homo Sapiens
RALLFQGVVDDEQVK

SEQ ID NO: 13027 - protein, 15 aa, Homo Sapiens
INQVLSNKDLINYNK

SEQ ID NO: 13028 - protein, 15 aa, Homo Sapiens
NQVLSNKDLINYNKF

SEQ ID NO: 13029 - protein, 15 aa, Homo Sapiens
NKDLINYNKFVQSCI

SEQ ID NO: 13030 - protein, 15 aa, Homo Sapiens
NKFVQSCIDWNREVL

SEQ ID NO: 13031 - protein, 15 aa, Homo Sapiens
VQSCIDWNREVLKRE

SEQ ID NO: 13032 - protein, 15 aa, Homo Sapiens
QSCIDWNREVLKREL

SEQ ID NO: 13033 - protein, 15 aa, Homo Sapiens
DWNREVLKRELGLAE

SEQ ID NO: 13034 - protein, 15 aa, Homo Sapiens
LGLAECDIIDIPQLF

SEQ ID NO: 13035 - protein, 15 aa, Homo Sapiens
ERKKATAFFPDLVNM

SEQ ID NO: 13036 - protein, 15 aa, Homo Sapiens
KHLGIPKPFGPIING

SEQ ID NO: 13037 - protein, 15 aa, Homo Sapiens
LGIPKPFGPIINGCC

SEQ ID NO: 13038 - protein, 15 aa, Homo Sapiens
FGPIINGCCCLEEKV

SEQ ID NO: 13039 - protein, 15 aa, Homo Sapiens
LHGEVHCGTNVCRKP

SEQ ID NO: 13040 - protein, 15 aa, Homo Sapiens
HGEVHCGTNVCRKPF

SEQ ID NO: 13041 - protein, 15 aa, Homo Sapiens
GTNVCRKPFSFKWWN

SEQ ID NO: 13042 - protein, 15 aa, Homo Sapiens
VPEGTEMFEVYGTPG

SEQ ID NO: 13043 - protein, 15 aa, Homo Sapiens
EMFEVYGTPGVDIYI

SEQ ID NO: 13044 - protein, 15 aa, Homo Sapiens
GTPGVDIYISPNMER

SEQ ID NO: 13045 - protein, 15 aa, Homo Sapiens
IYISPNMERGRERAD

SEQ ID NO: 13046 - protein, 15 aa, Homo Sapiens
ERGRERADTRRWRFD

SEQ ID NO: 13047 - protein, 15 aa, Homo Sapiens
SPSNDLNDSHVQISY

SEQ ID NO: 13048 - protein, 15 aa, Homo Sapiens
YLTCVDISLDCDLNC

SEQ ID NO: 13049 - protein, 15 aa, Homo Sapiens
FFVEGLSFPDAGFTG

SEQ ID NO: 13050 - protein, 15 aa, Homo Sapiens
AGFTGLISFHVTLLD

SEQ ID NO: 13051 - protein, 15 aa, Homo Sapiens
FHVTLLDDSNEDFSA

SEQ ID NO: 13052 - protein, 15 aa, Homo Sapiens
PPLEVYVCRVRNNTC

SEQ ID NO: 13053 - protein, 15 aa, Homo Sapiens
KTLPVVFDSPRNGEL

SEQ ID NO: 13054 - protein, 15 aa, Homo Sapiens
PRNGELQDFPYKRIL

SEQ ID NO: 13055 - protein, 15 aa, Homo Sapiens
RNGELQDFPYKRILG

SEQ ID NO: 13056 - protein, 15 aa, Homo Sapiens
EVSPPVVANGKEYPL

SEQ ID NO: 13057 - protein, 15 aa, Homo Sapiens
QKVQPPVELFVDWLA

SEQ ID NO: 13058 - protein, 15 aa, Homo Sapiens
DIIDIPQLFKTERKK

SEQ ID NO: 13059 - protein, 15 aa, Homo Sapiens
IDIPQLFKTERKKAT

SEQ ID NO: 13060 - protein, 15 aa, Homo Sapiens
SLQRIVRVSLEHPTS

SEQ ID NO: 13061 - protein, 15 aa, Homo Sapiens
FDATLEIIVVMNSPS

SEQ ID NO: 13062 - protein, 15 aa, Homo Sapiens
DLNDSHVQISYHSSH

SEQ ID NO: 13063 - protein, 15 aa, Homo Sapiens
SHVQISYHSSHEPLP

SEQ ID NO: 13064 - protein, 15 aa, Homo Sapiens
YHSSHEPLPLAYAVL

SEQ ID NO: 13065 - protein, 15 aa, Homo Sapiens
LPLAYAVLYLTCVDI

SEQ ID NO: 13066 - protein, 15 aa, Homo Sapiens
LYLTCVDISLDCDLN

SEQ ID NO: 13067 - protein, 15 aa, Homo Sapiens
LVNCDRDDPSCDVQD

SEQ ID NO: 13068 - protein, 15 aa, Homo Sapiens
DDPSCDVQDNCDQHV

SEQ ID NO: 13069 - protein, 15 aa, Homo Sapiens
DPSCDVQDNCDQHVH

SEQ ID NO: 13070 - protein, 15 aa, Homo Sapiens
DNCDQHVHCLQDLED

SEQ ID NO: 13071 - protein, 15 aa, Homo Sapiens
DLEDMSVMVLRTQGP

SEQ ID NO: 13072 - protein, 15 aa, Homo Sapiens
DAKRAQVFHICGPED

SEQ ID NO: 13073 - protein, 15 aa, Homo Sapiens
ICGPEDVCEAYRHVL

SEQ ID NO: 13074 - protein, 15 aa, Homo Sapiens
DKVSYEVPRLHGDEE

SEQ ID NO: 13075 - protein, 15 aa, Homo Sapiens
GLISFHVTLLDDSNE

SEQ ID NO: 13076 - protein, 15 aa, Homo Sapiens
SNEDFSASPIFTDTV

SEQ ID NO: 13077 - protein, 15 aa, Homo Sapiens
WIMTPSTLPPLEVYV

SEQ ID NO: 13078 - protein, 15 aa, Homo Sapiens
AELARKAGCKLTICP

SEQ ID NO: 13079 - protein, 15 aa, Homo Sapiens
VTREPRDRSVSGLDS

SEQ ID NO: 13080 - protein, 15 aa, Homo Sapiens
REPRDRSVSGLDSFG

SEQ ID NO: 13081 - protein, 15 aa, Homo Sapiens
IGGNLPGSSGRRVTQ

SEQ ID NO: 13082 - protein, 15 aa, Homo Sapiens
RRVTQVVRDFLHAQK

SEQ ID NO: 13083 - protein, 15 aa, Homo Sapiens
KTISINQVLSNKDLI

SEQ ID NO: 13084 - protein, 15 aa, Homo Sapiens
NYNKFVQSCIDWNRE

SEQ ID NO: 13085 - protein, 15 aa, Homo Sapiens
KFVQSCIDWNREVLK

SEQ ID NO: 13086 - protein, 15 aa, Homo Sapiens
GLAECDIIDIPQLFK

SEQ ID NO: 13087 - protein, 15 aa, Homo Sapiens
LGKHLGIPKPFGPII

SEQ ID NO: 13088 - protein, 15 aa, Homo Sapiens
HMLHGEVHCGTNVCR

SEQ ID NO: 13089 - protein, 15 aa, Homo Sapiens
PEGTEMFEVYGTPGV

SEQ ID NO: 13090 - protein, 15 aa, Homo Sapiens
YEVPRLHGDEERFFV

SEQ ID NO: 13091 - protein, 15 aa, Homo Sapiens
LHCTFIDDFTPYHML

SEQ ID NO: 13092 - protein, 15 aa, Homo Sapiens
PNMERGRERADTRRW

SEQ ID NO: 13093 - protein, 15 aa, Homo Sapiens
MERGRERADTRRWRF

SEQ ID NO: 13094 - protein, 15 aa, Homo Sapiens
RGRERADTRRWRFDA

SEQ ID NO: 13095 - protein, 15 aa, Homo Sapiens
GRQDRNFVDKRQWVW

SEQ ID NO: 13096 - protein, 15 aa, Homo Sapiens
DAVAELARKAGCKLT

SEQ ID NO: 13097 - protein, 15 aa, Homo Sapiens
PYKRILGPDFGYVTR

SEQ ID NO: 13098 - protein, 15 aa, Homo Sapiens
QVLSNKDLINYNKFV

SEQ ID NO: 13099 - protein, 15 aa, Homo Sapiens
DIPQLFKTERKKATA

SEQ ID NO: 13100 - protein, 15 aa, Homo Sapiens
RADTRRWRFDATLEI

SEQ ID NO: 13101 - protein, 15 aa, Homo Sapiens
NCEGRQDRNFVDKRQ

SEQ ID NO: 13102 - protein, 15 aa, Homo Sapiens
LVLHTSSYDAKRAQV

SEQ ID NO: 13103 - protein, 15 aa, Homo Sapiens
SSYDAKRAQVFHICG

SEQ ID NO: 13104 - protein, 15 aa, Homo Sapiens
KRAQVFHICGPEDVC

SEQ ID NO: 13105 - protein, 15 aa, Homo Sapiens
DVCEAYRHVLGQDKV

SEQ ID NO: 13106 - protein, 15 aa, Homo Sapiens
MTPSTLPPLEVYVCR

SEQ ID NO: 13107 - protein, 15 aa, Homo Sapiens
LTICPQAENRNDRWI

SEQ ID NO: 13108 - protein, 15 aa, Homo Sapiens
QAENRNDRWIQDEME

SEQ ID NO: 13109 - protein, 15 aa, Homo Sapiens
QDFPYKRILGPDFGY

SEQ ID NO: 13110 - protein, 15 aa, Homo Sapiens
ILGPDFGYVTREPRD

SEQ ID NO: 13111 - protein, 15 aa, Homo Sapiens
PVVANGKEYPLGRIL

SEQ ID NO: 13112 - protein, 15 aa, Homo Sapiens
KEYPLGRILIGGNLP

SEQ ID NO: 13113 - protein, 15 aa, Homo Sapiens
GNLPGSSGRRVTQVV

SEQ ID NO: 13114 - protein, 15 aa, Homo Sapiens
SSGRRVTQVVRDFLH

SEQ ID NO: 13115 - protein, 15 aa, Homo Sapiens
VVRDFLHAQKVQPPV

SEQ ID NO: 13116 - protein, 15 aa, Homo Sapiens
SCIDWNREVLKRELG

SEQ ID NO: 13117 - protein, 15 aa, Homo Sapiens
IPKPFGPIINGCCCL

SEQ ID NO: 13118 - protein, 15 aa, Homo Sapiens
DDFTPYHMLHGEVHC

SEQ ID NO: 13119 - protein, 15 aa, Homo Sapiens
TPYHMLHGEVHCGTN

SEQ ID NO: 13120 - protein, 15 aa, Homo Sapiens
NVCRKPFSFKWWNMV

SEQ ID NO: 13121 - protein, 15 aa, Homo Sapiens
LEHPTSAVCVAGVET

SEQ ID NO: 13122 - protein, 15 aa, Homo Sapiens
CVAGVETLVDIYGSV

SEQ ID NO: 13123 - protein, 15 aa, Homo Sapiens
RERADTRRWRFDATL

SEQ ID NO: 13124 - protein, 15 aa, Homo Sapiens
SLDCDLNCEGRQDRN

SEQ ID NO: 13125 - protein, 15 aa, Homo Sapiens
EGRQDRNFVDKRQWV

SEQ ID NO: 13126 - protein, 15 aa, Homo Sapiens
PSCDVQDNCDQHVHC

SEQ ID NO: 13127 - protein, 15 aa, Homo Sapiens
DVQDNCDQHVHCLQD

SEQ ID NO: 13128 - protein, 15 aa, Homo Sapiens
CDQHVHCLQDLEDMS

SEQ ID NO: 13129 - protein, 15 aa, Homo Sapiens
QDLEDMSVMVLRTQG

SEQ ID NO: 13130 - protein, 15 aa, Homo Sapiens
LHTSSYDAKRAQVFH

SEQ ID NO: 13131 - protein, 15 aa, Homo Sapiens
LGQDKVSYEVPRLHG

SEQ ID NO: 13132 - protein, 15 aa, Homo Sapiens
VSYEVPRLHGDEERF

SEQ ID NO: 13133 - protein, 15 aa, Homo Sapiens
EDFSASPIFTDTVVF

SEQ ID NO: 13134 - protein, 15 aa, Homo Sapiens
FTDTVVFRVAPWIMT

SEQ ID NO: 13135 - protein, 15 aa, Homo Sapiens
STLPPLEVYVCRVRN

SEQ ID NO: 13136 - protein, 15 aa, Homo Sapiens
CFVDAVAELARKAGC

SEQ ID NO: 13137 - protein, 15 aa, Homo Sapiens
LARKAGCKLTICPQA

SEQ ID NO: 13138 - protein, 15 aa, Homo Sapiens
PQAENRNDRWIQDEM

SEQ ID NO: 13139 - protein, 15 aa, Homo Sapiens
AENRNDRWIQDEMEL

SEQ ID NO: 13140 - protein, 15 aa, Homo Sapiens
VFDSPRNGELQDFPY

SEQ ID NO: 13141 - protein, 15 aa, Homo Sapiens
RILGPDFGYVTREPR

SEQ ID NO: 13142 - protein, 15 aa, Homo Sapiens
RDRSVSGLDSFGNLE

SEQ ID NO: 13143 - protein, 15 aa, Homo Sapiens
GNLEVSPPVVANGKE

SEQ ID NO: 13144 - protein, 15 aa, Homo Sapiens
SFVPAPDGKGFRMLL

SEQ ID NO: 13145 - protein, 15 aa, Homo Sapiens
SPGACFKLFQEKQKC

SEQ ID NO: 13146 - protein, 15 aa, Homo Sapiens
LFQGVVDDEQVKTIS

SEQ ID NO: 13147 - protein, 15 aa, Homo Sapiens
TERKKATAFFPDLVN

SEQ ID NO: 13148 - protein, 15 aa, Homo Sapiens
KKATAFFPDLVNMLV

SEQ ID NO: 13149 - protein, 15 aa, Homo Sapiens
GIPKPFGPIINGCCC

SEQ ID NO: 13150 - protein, 15 aa, Homo Sapiens
KVRSLLEPLGLHCTF

SEQ ID NO: 13151 - protein, 15 aa, Homo Sapiens
VCRKPFSFKWWNMVP

SEQ ID NO: 13152 - protein, 15 aa, Homo Sapiens
VAPWIMTPSTLAPLE

SEQ ID NO: 13153 - protein, 15 aa, Homo Sapiens
RVAPWIMTPSTLAPL

SEQ ID NO: 13154 - protein, 15 aa, Homo Sapiens
APWIMTPSTLAPLEV

SEQ ID NO: 13155 - protein, 15 aa, Homo Sapiens
IMTPSTLAPLEVYVC

SEQ ID NO: 13156 - protein, 15 aa, Homo Sapiens
VFRVAPWIMTPSTLA

SEQ ID NO: 13157 - protein, 15 aa, Homo Sapiens
PWIMTPSTLAPLEVY

SEQ ID NO: 13158 - protein, 15 aa, Homo Sapiens
PSTLAPLEVYVCRVR

SEQ ID NO: 13159 - protein, 15 aa, Homo Sapiens
TLAPLEVYVCRVRNN

SEQ ID NO: 13160 - protein, 15 aa, Homo Sapiens
FRVAPWIMTPSTLAP

SEQ ID NO: 13161 - protein, 15 aa, Homo Sapiens
LAPLEVYVCRVRNNT

SEQ ID NO: 13162 - protein, 15 aa, Homo Sapiens
WIMTPSTLAPLEVYV

SEQ ID NO: 13163 - protein, 15 aa, Homo Sapiens
TPSTLAPLEVYVCRV

SEQ ID NO: 13164 - protein, 15 aa, Homo Sapiens
APLEVYVCRVRNNTC

SEQ ID NO: 13165 - protein, 15 aa, Homo Sapiens
MTPSTLAPLEVYVCR

SEQ ID NO: 13166 - protein, 15 aa, Homo Sapiens
STLAPLEVYVCRVRN

SEQ ID NO: 13167 - protein, 15 aa, Homo Sapiens
LSFVPVPDGKGFRML

SEQ ID NO: 13168 - protein, 15 aa, Homo Sapiens
FVPVPDGKGFRMLLA

SEQ ID NO: 13169 - protein, 15 aa, Homo Sapiens
VGHVDEFLSFVPVPD

SEQ ID NO: 13170 - protein, 15 aa, Homo Sapiens
FLSFVPVPDGKGFRM

SEQ ID NO: 13171 - protein, 15 aa, Homo Sapiens
GHVDEFLSFVPVPDG

SEQ ID NO: 13172 - protein, 15 aa, Homo Sapiens
VDEFLSFVPVPDGKG

SEQ ID NO: 13173 - protein, 15 aa, Homo Sapiens
DEFLSFVPVPDGKGF

SEQ ID NO: 13174 - protein, 15 aa, Homo Sapiens
VPVPDGKGFRMLLAS

SEQ ID NO: 13175 - protein, 15 aa, Homo Sapiens
PVPDGKGFRMLLASP

SEQ ID NO: 13176 - protein, 15 aa, Homo Sapiens
LAVGHVDEFLSFVPV

SEQ ID NO: 13177 - protein, 15 aa, Homo Sapiens
AVGHVDEFLSFVPVP

SEQ ID NO: 13178 - protein, 15 aa, Homo Sapiens
HVDEFLSFVPVPDGK

SEQ ID NO: 13179 - protein, 15 aa, Homo Sapiens
VPDGKGFRMLLASPG

SEQ ID NO: 13180 - protein, 15 aa, Homo Sapiens
EFLSFVPVPDGKGFR

SEQ ID NO: 13181 - protein, 15 aa, Homo Sapiens
SFVPVPDGKGFRMLL

SEQ ID NO: 13182 - protein, 15 aa, Homo Sapiens
HVTLLDDSNEDFSAS

SEQ ID NO: 13183 - protein, 15 aa, Homo Sapiens
PAALFDDHKLVLHTS

SEQ ID NO: 13184 - protein, 15 aa, Homo Sapiens
VPRLHGDEERFFVEG

SEQ ID NO: 13185 - protein, 15 aa, Homo Sapiens
FQGVVDDEQVKTISI

SEQ ID NO: 13186 - protein, 15 aa, Homo Sapiens
ATAFFPDLVNMLVLG

SEQ ID NO: 13187 - protein, 15 aa, Homo Sapiens
DISLDCDLNCEGRQD

SEQ ID NO: 13188 - protein, 15 aa, Homo Sapiens
YRHVLGQDKVSYEVP

SEQ ID NO: 13189 - protein, 15 aa, Homo Sapiens
CCCLEEKVRSLLEPL

SEQ ID NO: 13190 - protein, 15 aa, Homo Sapiens
PEDVCEAYRHVLGQD

SEQ ID NO: 13191 - protein, 15 aa, Homo Sapiens
DRWIQDEMELGYVQA

SEQ ID NO: 13192 - protein, 15 aa, Homo Sapiens
PPVVANGKEYPLGRI

SEQ ID NO: 13193 - protein, 15 aa, Homo Sapiens
GRRVTQVVRDFLHAQ

SEQ ID NO: 13194 - protein, 15 aa, Homo Sapiens
CVDISLDCDLNCEGR

SEQ ID NO: 13195 - protein, 15 aa, Homo Sapiens
TLPVVFDSPRNGELQ

SEQ ID NO: 13196 - protein, 15 aa, Homo Sapiens
PVVFDSPRNGELQDF

SEQ ID NO: 13197 - protein, 15 aa, Homo Sapiens
VMVLRTQGPAALFDD

SEQ ID NO: 13198 - protein, 15 aa, Homo Sapiens
VTQVVRDFLHAQKVQ

SEQ ID NO: 13199 - protein, 15 aa, Homo Sapiens
FRMLLASPGACFKLF

SEQ ID NO: 13200 - protein, 15 aa, Homo Sapiens
HEPLPLAYAVLYLTC

SEQ ID NO: 13201 - protein, 15 aa, Homo Sapiens
RHVLGQDKVSYEVPR

SEQ ID NO: 13202 - protein, 15 aa, Homo Sapiens
FTGLISFHVTLLDDS

SEQ ID NO: 13203 - protein, 15 aa, Homo Sapiens
ASPIFTDTVVFRVAP

SEQ ID NO: 13204 - protein, 15 aa, Homo Sapiens
KRILGPDFGYVTREP

SEQ ID NO: 13205 - protein, 15 aa, Homo Sapiens
RSVSGLDSFGNLEVS

SEQ ID NO: 13206 - protein, 15 aa, Homo Sapiens
PVELFVDWLAVGHVD

SEQ ID NO: 13207 - protein, 15 aa, Homo Sapiens
AECDIIDIPQLFKTE

SEQ ID NO: 13208 - protein, 15 aa, Homo Sapiens
IIVVMNSPSNDLNDS

SEQ ID NO: 13209 - protein, 15 aa, Homo Sapiens
ILLVNCDRDDPSCDV

SEQ ID NO: 13210 - protein, 15 aa, Homo Sapiens
HICGPEDVCEAYRHV

SEQ ID NO: 13211 - protein, 15 aa, Homo Sapiens
PWIMTPSTLPPLEVY

SEQ ID NO: 13212 - protein, 15 aa, Homo Sapiens
LGRILIGGNLPGSSG

SEQ ID NO: 13213 - protein, 15 aa, Homo Sapiens
LAVGHVDEFLSFVPA

SEQ ID NO: 13214 - protein, 15 aa, Homo Sapiens
LVNMLVLGKHLGIPK

SEQ ID NO: 13215 - protein, 15 aa, Homo Sapiens
EEKVRSLLEPLGLHC

SEQ ID NO: 13216 - protein, 15 aa, Homo Sapiens
TSAVCVAGVETLVDI

SEQ ID NO: 13217 - protein, 15 aa, Homo Sapiens
IVVMNSPSNDLNDSH

SEQ ID NO: 13218 - protein, 15 aa, Homo Sapiens
LTCVDISLDCDLNCE

SEQ ID NO: 13219 - protein, 15 aa, Homo Sapiens
HVHCLQDLEDMSVMV

SEQ ID NO: 13220 - protein, 15 aa, Homo Sapiens
LQDLEDMSVMVLRTQ

SEQ ID NO: 13221 - protein, 15 aa, Homo Sapiens
NNTCFVDAVAELARK

SEQ ID NO: 13222 - protein, 15 aa, Homo Sapiens
VAELARKAGCKLTIC

SEQ ID NO: 13223 - protein, 15 aa, Homo Sapiens
GCKLTICPQAENRND

SEQ ID NO: 13224 - protein, 15 aa, Homo Sapiens
VSGLDSFGNLEVSPP

SEQ ID NO: 13225 - protein, 15 aa, Homo Sapiens
NQVLSNKDLINYNKF

SEQ ID NO: 13226 - protein, 15 aa, Homo Sapiens
ECDIIDIPQLFKTER

SEQ ID NO: 13227 - protein, 15 aa, Homo Sapiens
HCTFIDDFTPYHMLH

SEQ ID NO: 13228 - protein, 15 aa, Homo Sapiens
QRIVRVSLEHPTSAV

SEQ ID NO: 13229 - protein, 15 aa, Homo Sapiens
DCDLNCEGRQDRNFV

SEQ ID NO: 13230 - protein, 15 aa, Homo Sapiens
QDRNFVDKRQWVWGP

SEQ ID NO: 13231 - protein, 15 aa, Homo Sapiens
MSVMVLRTQGPAALF

SEQ ID NO: 13232 - protein, 15 aa, Homo Sapiens
TCFVDAVAELARKAG

SEQ ID NO: 13233 - protein, 15 aa, Homo Sapiens
VDAVAELARKAGCKL

SEQ ID NO: 13234 - protein, 15 aa, Homo Sapiens
KLTICPQAENRNDRW

SEQ ID NO: 13235 - protein, 15 aa, Homo Sapiens
LPVVFDSPRNGELQD

SEQ ID NO: 13236 - protein, 15 aa, Homo Sapiens
FGYVTREPRDRSVSG

SEQ ID NO: 13237 - protein, 15 aa, Homo Sapiens
SPPVVANGKEYPLGR

SEQ ID NO: 13238 - protein, 15 aa, Homo Sapiens
AQKVQPPVELFVDWL

SEQ ID NO: 13239 - protein, 15 aa, Homo Sapiens
VDWLAVGHVDEFLSF

SEQ ID NO: 13240 - protein, 15 aa, Homo Sapiens
LSFVPAPDGKGFRML

SEQ ID NO: 13241 - protein, 15 aa, Homo Sapiens
SFVPAPDGKGFRMLL

SEQ ID NO: 13242 - protein, 15 aa, Homo Sapiens
LFQGVVDDEQVKTIS

SEQ ID NO: 13243 - protein, 15 aa, Homo Sapiens
QSCIDWNREVLKREL

SEQ ID NO: 13244 - protein, 15 aa, Homo Sapiens
IPQLFKTERKKATAF

SEQ ID NO: 13245 - protein, 15 aa, Homo Sapiens
PLGLHCTFIDDFTPY

SEQ ID NO: 13246 - protein, 15 aa, Homo Sapiens
LHCTFIDDFTPYHML

SEQ ID NO: 13247 - protein, 15 aa, Homo Sapiens
YGSVPEGTEMFEVYG

SEQ ID NO: 13248 - protein, 15 aa, Homo Sapiens
GVDIYISPNMERGRE

SEQ ID NO: 13249 - protein, 15 aa, Homo Sapiens
DIYISPNMERGRERA

SEQ ID NO: 13250 - protein, 15 aa, Homo Sapiens
SPNMERGRERADTRR

SEQ ID NO: 13251 - protein, 15 aa, Homo Sapiens
RGRERADTRRWRFDA

SEQ ID NO: 13252 - protein, 15 aa, Homo Sapiens
TLEIIVVMNSPSNDL

SEQ ID NO: 13253 - protein, 15 aa, Homo Sapiens
MNSPSNDLNDSHVQI

SEQ ID NO: 13254 - protein, 15 aa, Homo Sapiens
NCEGRQDRNFVDKRQ

SEQ ID NO: 13255 - protein, 15 aa, Homo Sapiens
GILLVNCDRDDPSCD

SEQ ID NO: 13256 - protein, 15 aa, Homo Sapiens
RDDPSCDVQDNCDQH

SEQ ID NO: 13257 - protein, 15 aa, Homo Sapiens
LHTSSYDAKRAQVFH

SEQ ID NO: 13258 - protein, 15 aa, Homo Sapiens
GLSFPDAGFTGLISF

SEQ ID NO: 13259 - protein, 15 aa, Homo Sapiens
EVYVCRVRNNTCFVD

SEQ ID NO: 13260 - protein, 15 aa, Homo Sapiens
LGYVQAPHKTLPVVF

SEQ ID NO: 13261 - protein, 15 aa, Homo Sapiens
VRDFLHAQKVQPPVE

SEQ ID NO: 13262 - protein, 15 aa, Homo Sapiens
WLAVGHVDEFLSFVP

SEQ ID NO: 13263 - protein, 15 aa, Homo Sapiens
CFKLFQEKQKCGHGR

SEQ ID NO: 13264 - protein, 15 aa, Homo Sapiens
EKQKCGHGRALLFQG

SEQ ID NO: 13265 - protein, 15 aa, Homo Sapiens
NKDLINYNKFVQSCI

SEQ ID NO: 13266 - protein, 15 aa, Homo Sapiens
IDWNREVLKRELGLA

SEQ ID NO: 13267 - protein, 15 aa, Homo Sapiens
WNREVLKRELGLAEC

SEQ ID NO: 13268 - protein, 15 aa, Homo Sapiens
HGEVHCGTNVCRKPF

SEQ ID NO: 13269 - protein, 15 aa, Homo Sapiens
EVPRLHGDEERFFVE

SEQ ID NO: 13270 - protein, 15 aa, Homo Sapiens
VTLLDDSNEDFSASP

SEQ ID NO: 13271 - protein, 15 aa, Homo Sapiens
GACFKLFQEKQKCGH

SEQ ID NO: 13272 - protein, 15 aa, Homo Sapiens
EQVKTISINQVLSNK

SEQ ID NO: 13273 - protein, 15 aa, Homo Sapiens
FVQSCIDWNREVLKR

SEQ ID NO: 13274 - protein, 15 aa, Homo Sapiens
IIDIPQLFKTERKKA

SEQ ID NO: 13275 - protein, 15 aa, Homo Sapiens
PQLFKTERKKATAFF

SEQ ID NO: 13276 - protein, 15 aa, Homo Sapiens
RWRFDATLEIIVVMN

SEQ ID NO: 13277 - protein, 15 aa, Homo Sapiens
NDLNDSHVQISYHSS

SEQ ID NO: 13278 - protein, 15 aa, Homo Sapiens
DRNFVDKRQWVWGPS

SEQ ID NO: 13279 - protein, 15 aa, Homo Sapiens
VYVCRVRNNTCFVDA

SEQ ID NO: 13280 - protein, 15 aa, Homo Sapiens
PAPDGKGFRMLLASP

SEQ ID NO: 13281 - protein, 15 aa, Homo Sapiens
GFRMLLASPGACFKL

SEQ ID NO: 13282 - protein, 15 aa, Homo Sapiens
FKLFQEKQKCGHGRA

SEQ ID NO: 13283 - protein, 15 aa, Homo Sapiens
ISINQVLSNKDLINY

SEQ ID NO: 13284 - protein, 15 aa, Homo Sapiens
INQVLSNKDLINYNK

SEQ ID NO: 13285 - protein, 15 aa, Homo Sapiens
VQSCIDWNREVLKRE

SEQ ID NO: 13286 - protein, 15 aa, Homo Sapiens
TAFFPDLVNMLVLGK

SEQ ID NO: 13287 - protein, 15 aa, Homo Sapiens
PKPFGPIINGCCCLE

SEQ ID NO: 13288 - protein, 15 aa, Homo Sapiens
VRSLLEPLGLHCTFI

SEQ ID NO: 13289 - protein, 15 aa, Homo Sapiens
VHCGTNVCRKPFSFK

SEQ ID NO: 13290 - protein, 15 aa, Homo Sapiens
GRERADTRRWRFDAT

SEQ ID NO: 13291 - protein, 15 aa, Homo Sapiens
EIIVVMNSPSNDLND

SEQ ID NO: 13292 - protein, 15 aa, Homo Sapiens
PSNDLNDSHVQISYH

SEQ ID NO: 13293 - protein, 15 aa, Homo Sapiens
CLQDLEDMSVMVLRT

SEQ ID NO: 13294 - protein, 15 aa, Homo Sapiens
FHVTLLDDSNEDFSA

SEQ ID NO: 13295 - protein, 15 aa, Homo Sapiens
RNDRWIQDEMELGYV

SEQ ID NO: 13296 - protein, 15 aa, Homo Sapiens
GELQDFPYKRILGPD

SEQ ID NO: 13297 - protein, 15 aa, Homo Sapiens
GPDFGYVTREPRDRS

SEQ ID NO: 13298 - protein, 15 aa, Homo Sapiens
GRALLFQGVVDDEQV

SEQ ID NO: 13299 - protein, 15 aa, Homo Sapiens
NREVLKRELGLAECD

SEQ ID NO: 13300 - protein, 15 aa, Homo Sapiens
REVLKRELGLAECDI

SEQ ID NO: 13301 - protein, 15 aa, Homo Sapiens
VNMLVLGKHLGIPKP

SEQ ID NO: 13302 - protein, 15 aa, Homo Sapiens
AYAVLYLTCVDISLD

SEQ ID NO: 13303 - protein, 15 aa, Homo Sapiens
YGGILLVNCDRDDPS

SEQ ID NO: 13304 - protein, 15 aa, Homo Sapiens
SVMVLRTQGPAALFD

SEQ ID NO: 13305 - protein, 15 aa, Homo Sapiens
GPAALFDDHKLVLHT

SEQ ID NO: 13306 - protein, 15 aa, Homo Sapiens
HKLVLHTSSYDAKRA

SEQ ID NO: 13307 - protein, 15 aa, Homo Sapiens
FVEGLSFPDAGFTGL

SEQ ID NO: 13308 - protein, 15 aa, Homo Sapiens
SFHVTLLDDSNEDFS

SEQ ID NO: 13309 - protein, 15 aa, Homo Sapiens
NDRWIQDEMELGYVQ

SEQ ID NO: 13310 - protein, 15 aa, Homo Sapiens
QDEMELGYVQAPHKT

SEQ ID NO: 13311 - protein, 15 aa, Homo Sapiens
RNGELQDFPYKRILG

SEQ ID NO: 13312 - protein, 15 aa, Homo Sapiens
NLEVSPPVVANGKEY

SEQ ID NO: 13313 - protein, 15 aa, Homo Sapiens
TQVVRDFLHAQKVQP

SEQ ID NO: 13314 - protein, 15 aa, Homo Sapiens
DEQVKTISINQVLSN

SEQ ID NO: 13315 - protein, 15 aa, Homo Sapiens
TISINQVLSNKDLIN

SEQ ID NO: 13316 - protein, 15 aa, Homo Sapiens
FPDLVNMLVLGKHLG

SEQ ID NO: 13317 - protein, 15 aa, Homo Sapiens
PYHMLHGEVHCGTNV

SEQ ID NO: 13318 - protein, 15 aa, Homo Sapiens
LQRIVRVSLEHPTSA

SEQ ID NO: 13319 - protein, 15 aa, Homo Sapiens
AVCVAGVETLVDIYG

SEQ ID NO: 13320 - protein, 15 aa, Homo Sapiens
GVETLVDIYGSVPEG

SEQ ID NO: 13321 - protein, 15 aa, Homo Sapiens
ETLVDIYGSVPEGTE

SEQ ID NO: 13322 - protein, 15 aa, Homo Sapiens
MFEVYGTPGVDIYIS

SEQ ID NO: 13323 - protein, 15 aa, Homo Sapiens
TRRWRFDATLEIIVV

SEQ ID NO: 13324 - protein, 15 aa, Homo Sapiens
YHSSHEPLPLAYAVL

SEQ ID NO: 13325 - protein, 15 aa, Homo Sapiens
SHEPLPLAYAVLYLT

SEQ ID NO: 13326 - protein, 15 aa, Homo Sapiens
VLYLTCVDISLDCDL

SEQ ID NO: 13327 - protein, 15 aa, Homo Sapiens
GGILLVNCDRDDPSC

SEQ ID NO: 13328 - protein, 15 aa, Homo Sapiens
VNCDRDDPSCDVQDN

SEQ ID NO: 13329 - protein, 15 aa, Homo Sapiens
MVLRTQGPAALFDDH

SEQ ID NO: 13330 - protein, 15 aa, Homo Sapiens
DHKLVLHTSSYDAKR

SEQ ID NO: 13331 - protein, 15 aa, Homo Sapiens
KLVLHTSSYDAKRAQ

SEQ ID NO: 13332 - protein, 15 aa, Homo Sapiens
VFHICGPEDVCEAYR

SEQ ID NO: 13333 - protein, 15 aa, Homo Sapiens
TGLISFHVTLLDDSN

SEQ ID NO: 13334 - protein, 15 aa, Homo Sapiens
LDDSNEDFSASPIFT

SEQ ID NO: 13335 - protein, 15 aa, Homo Sapiens
APWIMTPSTLPPLEV

SEQ ID NO: 13336 - protein, 15 aa, Homo Sapiens
PSTLPPLEVYVCRVR

SEQ ID NO: 13337 - protein, 15 aa, Homo Sapiens
YKRILGPDFGYVTRE

SEQ ID NO: 13338 - protein, 15 aa, Homo Sapiens
FGNLEVSPPVVANGK

SEQ ID NO: 13339 - protein, 15 aa, Homo Sapiens
RDFLHAQKVQPPVEL

SEQ ID NO: 13340 - protein, 15 aa, Homo Sapiens
QPPVELFVDWLAVGH

SEQ ID NO: 13341 - protein, 15 aa, Homo Sapiens
VGHVDEFLSFVPAPD

SEQ ID NO: 13342 - protein, 15 aa, Homo Sapiens
VDEFLSFVPAPDGKG

SEQ ID NO: 13343 - protein, 15 aa, Homo Sapiens
FLSFVPAPDGKGFRM

SEQ ID NO: 13344 - protein, 15 aa, Homo Sapiens
RMLLASPGACFKLFQ

SEQ ID NO: 13345 - protein, 15 aa, Homo Sapiens
QVLSNKDLINYNKFV

SEQ ID NO: 13346 - protein, 15 aa, Homo Sapiens
KDLINYNKFVQSCID

SEQ ID NO: 13347 - protein, 15 aa, Homo Sapiens
NKFVQSCIDWNREVL

SEQ ID NO: 13348 - protein, 15 aa, Homo Sapiens
KRELGLAECDIIDIP

SEQ ID NO: 13349 - protein, 15 aa, Homo Sapiens
PDLVNMLVLGKHLGI

SEQ ID NO: 13350 - protein, 15 aa, Homo Sapiens
NMLVLGKHLGIPKPF

SEQ ID NO: 13351 - protein, 15 aa, Homo Sapiens
FGPIINGCCCLEEKV

SEQ ID NO: 13352 - protein, 15 aa, Homo Sapiens
GCCCLEEKVRSLLEP

SEQ ID NO: 13353 - protein, 15 aa, Homo Sapiens
RSLLEPLGLHCTFID

SEQ ID NO: 13354 - protein, 15 aa, Homo Sapiens
IVRVSLEHPTSAVCV

SEQ ID NO: 13355 - protein, 15 aa, Homo Sapiens
RVSLEHPTSAVCVAG

SEQ ID NO: 13356 - protein, 15 aa, Homo Sapiens
CVAGVETLVDIYGSV

SEQ ID NO: 13357 - protein, 15 aa, Homo Sapiens
VETLVDIYGSVPEGT

SEQ ID NO: 13358 - protein, 15 aa, Homo Sapiens
IYGSVPEGTEMFEVY

SEQ ID NO: 13359 - protein, 15 aa, Homo Sapiens
GTEMFEVYGTPGVDI

SEQ ID NO: 13360 - protein, 15 aa, Homo Sapiens
TPGVDIYISPNMERG

SEQ ID NO: 13361 - protein, 15 aa, Homo Sapiens
DATLEIIVVMNSPSN

SEQ ID NO: 13362 - protein, 15 aa, Homo Sapiens
LEIIVVMNSPSNDLN

SEQ ID NO: 13363 - protein, 15 aa, Homo Sapiens
SNDLNDSHVQISYHS

SEQ ID NO: 13364 - protein, 15 aa, Homo Sapiens
HVQISYHSSHEPLPL

SEQ ID NO: 13365 - protein, 15 aa, Homo Sapiens
ISYHSSHEPLPLAYA

SEQ ID NO: 13366 - protein, 15 aa, Homo Sapiens
EPLPLAYAVLYLTCV

SEQ ID NO: 13367 - protein, 15 aa, Homo Sapiens
PLPLAYAVLYLTCVD

SEQ ID NO: 13368 - protein, 15 aa, Homo Sapiens
YAVLYLTCVDISLDC

SEQ ID NO: 13369 - protein, 15 aa, Homo Sapiens
LYLTCVDISLDCDLN

SEQ ID NO: 13370 - protein, 15 aa, Homo Sapiens
RNFVDKRQWVWGPSG

SEQ ID NO: 13371 - protein, 15 aa, Homo Sapiens
RQWVWGPSGYGGILL

SEQ ID NO: 13372 - protein, 15 aa, Homo Sapiens
PSCDVQDNCDQHVHC

SEQ ID NO: 13373 - protein, 15 aa, Homo Sapiens
SCDVQDNCDQHVHCL

SEQ ID NO: 13374 - protein, 15 aa, Homo Sapiens
DVQDNCDQHVHCLQD

SEQ ID NO: 13375 - protein, 15 aa, Homo Sapiens
DQHVHCLQDLEDMSV

SEQ ID NO: 13376 - protein, 15 aa, Homo Sapiens
VHCLQDLEDMSVMVL

SEQ ID NO: 13377 - protein, 15 aa, Homo Sapiens
DMSVMVLRTQGPAAL

SEQ ID NO: 13378 - protein, 15 aa, Homo Sapiens
AALFDDHKLVLHTSS

SEQ ID NO: 13379 - protein, 15 aa, Homo Sapiens
GQDKVSYEVPRLHGD

SEQ ID NO: 13380 - protein, 15 aa, Homo Sapiens
QDKVSYEVPRLHGDE

SEQ ID NO: 13381 - protein, 15 aa, Homo Sapiens
ERFFVEGLSFPDAGF

SEQ ID NO: 13382 - protein, 15 aa, Homo Sapiens
RFFVEGLSFPDAGFT

SEQ ID NO: 13383 - protein, 15 aa, Homo Sapiens
EGLSFPDAGFTGLIS

SEQ ID NO: 13384 - protein, 15 aa, Homo Sapiens
GFTGLISFHVTLLDD

SEQ ID NO: 13385 - protein, 15 aa, Homo Sapiens
TDTVVFRVAPWIMTP

SEQ ID NO: 13386 - protein, 15 aa, Homo Sapiens
VFRVAPWIMTPSTLP

SEQ ID NO: 13387 - protein, 15 aa, Homo Sapiens
MTPSTLPPLEVYVCR

SEQ ID NO: 13388 - protein, 15 aa, Homo Sapiens
TPSTLPPLEVYVCRV

SEQ ID NO: 13389 - protein, 15 aa, Homo Sapiens
PLEVYVCRVRNNTCF

SEQ ID NO: 13390 - protein, 15 aa, Homo Sapiens
VCRVRNNTCFVDAVA

SEQ ID NO: 13391 - protein, 15 aa, Homo Sapiens
QAENRNDRWIQDEME

SEQ ID NO: 13392 - protein, 15 aa, Homo Sapiens
FDSPRNGELQDFPYK

SEQ ID NO: 13393 - protein, 15 aa, Homo Sapiens
NGELQDFPYKRILGP

SEQ ID NO: 13394 - protein, 15 aa, Homo Sapiens
PYKRILGPDFGYVTR

SEQ ID NO: 13395 - protein, 15 aa, Homo Sapiens
VTREPRDRSVSGLDS

SEQ ID NO: 13396 - protein, 15 aa, Homo Sapiens
EYPLGRILIGGNLPG

SEQ ID NO: 13397 - protein, 15 aa, Homo Sapiens
GRILIGGNLPGSSGR

SEQ ID NO: 13398 - protein, 15 aa, Homo Sapiens
RILIGGNLPGSSGRR

SEQ ID NO: 13399 - protein, 15 aa, Homo Sapiens
GGNLPGSSGRRVTQV

SEQ ID NO: 13400 - protein, 15 aa, Homo Sapiens
LHAQKVQPPVELFVD

SEQ ID NO: 13401 - protein, 15 aa, Homo Sapiens
HAQKVQPPVELFVDW

SEQ ID NO: 13402 - protein, 15 aa, Homo Sapiens
VELFVDWLAVGHVDE

SEQ ID NO: 13403 - protein, 15 aa, Homo Sapiens
DEFLSFVPAPDGKGF

SEQ ID NO: 13404 - protein, 15 aa, Homo Sapiens
GKGFRMLLASPGACF

SEQ ID NO: 13405 - protein, 15 aa, Homo Sapiens
ACFKLFQEKQKCGHG

SEQ ID NO: 13406 - protein, 15 aa, Homo Sapiens
VKTISINQVLSNKDL

SEQ ID NO: 13407 - protein, 15 aa, Homo Sapiens
LSNKDLINYNKFVQS

SEQ ID NO: 13408 - protein, 15 aa, Homo Sapiens
ELGLAECDIIDIPQL

SEQ ID NO: 13409 - protein, 15 aa, Homo Sapiens
CDIIDIPQLFKTERK

SEQ ID NO: 13410 - protein, 15 aa, Homo Sapiens
MLVLGKHLGIPKPFG

SEQ ID NO: 13411 - protein, 15 aa, Homo Sapiens
GKHLGIPKPFGPIIN

SEQ ID NO: 13412 - protein, 15 aa, Homo Sapiens
GPIINGCCCLEEKVR

SEQ ID NO: 13413 - protein, 15 aa, Homo Sapiens
EKVRSLLEPLGLHCT

SEQ ID NO: 13414 - protein, 15 aa, Homo Sapiens
LEPLGLHCTFIDDFT

SEQ ID NO: 13415 - protein, 15 aa, Homo Sapiens
IDDFTPYHMLHGEVH

SEQ ID NO: 13416 - protein, 15 aa, Homo Sapiens
GTNVCRKPFSFKWWN

SEQ ID NO: 13417 - protein, 15 aa, Homo Sapiens
VAGVETLVDIYGSVP

SEQ ID NO: 13418 - protein, 15 aa, Homo Sapiens
LVDIYGSVPEGTEMF

SEQ ID NO: 13419 - protein, 15 aa, Homo Sapiens
YGTPGVDIYISPNME

SEQ ID NO: 13420 - protein, 15 aa, Homo Sapiens
ADTRRWRFDATLEII

SEQ ID NO: 13421 - protein, 15 aa, Homo Sapiens
DSHVQISYHSSHEPL

SEQ ID NO: 13422 - protein, 15 aa, Homo Sapiens
AVLYLTCVDISLDCD

SEQ ID NO: 13423 - protein, 15 aa, Homo Sapiens
VWGPSGYGGILLVNC

SEQ ID NO: 13424 - protein, 15 aa, Homo Sapiens
LVNCDRDDPSCDVQD

SEQ ID NO: 13425 - protein, 15 aa, Homo Sapiens
LEDMSVMVLRTQGPA

SEQ ID NO: 13426 - protein, 15 aa, Homo Sapiens
QGPAALFDDHKLVLH

SEQ ID NO: 13427 - protein, 15 aa, Homo Sapiens
DDHKLVLHTSSYDAK

SEQ ID NO: 13428 - protein, 15 aa, Homo Sapiens
RAQVFHICGPEDVCE

SEQ ID NO: 13429 - protein, 15 aa, Homo Sapiens
SYEVPRLHGDEERFF

SEQ ID NO: 13430 - protein, 15 aa, Homo Sapiens
DEERFFVEGLSFPDA

SEQ ID NO: 13431 - protein, 15 aa, Homo Sapiens
VEGLSFPDAGFTGLI

SEQ ID NO: 13432 - protein, 15 aa, Homo Sapiens
SASPIFTDTVVFRVA

SEQ ID NO: 13433 - protein, 15 aa, Homo Sapiens
DTVVFRVAPWIMTPS

SEQ ID NO: 13434 - protein, 15 aa, Homo Sapiens
TVVFRVAPWIMTPST

SEQ ID NO: 13435 - protein, 15 aa, Homo Sapiens
LPPLEVYVCRVRNNT

SEQ ID NO: 13436 - protein, 15 aa, Homo Sapiens
NTCFVDAVAELARKA

SEQ ID NO: 13437 - protein, 15 aa, Homo Sapiens
EMELGYVQAPHKTLP

SEQ ID NO: 13438 - protein, 15 aa, Homo Sapiens
ELGYVQAPHKTLPVV

SEQ ID NO: 13439 - protein, 15 aa, Homo Sapiens
VQAPHKTLPVVFDSP

SEQ ID NO: 13440 - protein, 15 aa, Homo Sapiens
HKTLPVVFDSPRNGE

SEQ ID NO: 13441 - protein, 15 aa, Homo Sapiens
DFPYKRILGPDFGYV

SEQ ID NO: 13442 - protein, 15 aa, Homo Sapiens
TREPRDRSVSGLDSF

SEQ ID NO: 13443 - protein, 15 aa, Homo Sapiens
DRSVSGLDSFGNLEV

SEQ ID NO: 13444 - protein, 15 aa, Homo Sapiens
YPLGRILIGGNLPGS

SEQ ID NO: 13445 - protein, 15 aa, Homo Sapiens
VQPPVELFVDWLAVG

SEQ ID NO: 13446 - protein, 15 aa, Homo Sapiens
ELFVDWLAVGHVDEF

SEQ ID NO: 13447 - protein, 15 aa, Homo Sapiens
MLLASPGACFKLFQE

SEQ ID NO: 13448 - protein, 15 aa, Homo Sapiens
QEKQKCGHGRALLFQ

SEQ ID NO: 13449 - protein, 15 aa, Homo Sapiens
KQKCGHGRALLFQGV

SEQ ID NO: 13450 - protein, 15 aa, Homo Sapiens
RALLFQGVVDDEQVK

SEQ ID NO: 13451 - protein, 15 aa, Homo Sapiens
QGVVDDEQVKTISIN

SEQ ID NO: 13452 - protein, 15 aa, Homo Sapiens
QVKTISINQVLSNKD

SEQ ID NO: 13453 - protein, 15 aa, Homo Sapiens
LGLAECDIIDIPQLF

SEQ ID NO: 13454 - protein, 15 aa, Homo Sapiens
QLFKTERKKATAFFP

SEQ ID NO: 13455 - protein, 15 aa, Homo Sapiens
LFKTERKKATAFFPD

SEQ ID NO: 13456 - protein, 15 aa, Homo Sapiens
FKTERKKATAFFPDL

SEQ ID NO: 13457 - protein, 15 aa, Homo Sapiens
AFFPDLVNMLVLGKH

SEQ ID NO: 13458 - protein, 15 aa, Homo Sapiens
DLVNMLVLGKHLGIP

SEQ ID NO: 13459 - protein, 15 aa, Homo Sapiens
HLGIPKPFGPIINGC

SEQ ID NO: 13460 - protein, 15 aa, Homo Sapiens
PFGPIINGCCCLEEK

SEQ ID NO: 13461 - protein, 15 aa, Homo Sapiens
LEEKVRSLLEPLGLH

SEQ ID NO: 13462 - protein, 15 aa, Homo Sapiens
SLLEPLGLHCTFIDD

SEQ ID NO: 13463 - protein, 15 aa, Homo Sapiens
CTFIDDFTPYHMLHG

SEQ ID NO: 13464 - protein, 15 aa, Homo Sapiens
YHMLHGEVHCGTNVC

SEQ ID NO: 13465 - protein, 15 aa, Homo Sapiens
CGTNVCRKPFSFKWW

SEQ ID NO: 13466 - protein, 15 aa, Homo Sapiens
VPEGTEMFEVYGTPG

SEQ ID NO: 13467 - protein, 15 aa, Homo Sapiens
TEMFEVYGTPGVDIY

SEQ ID NO: 13468 - protein, 15 aa, Homo Sapiens
FEVYGTPGVDIYISP

SEQ ID NO: 13469 - protein, 15 aa, Homo Sapiens
PNMERGRERADTRRW

SEQ ID NO: 13470 - protein, 15 aa, Homo Sapiens
VQISYHSSHEPLPLA

SEQ ID NO: 13471 - protein, 15 aa, Homo Sapiens
DLNCEGRQDRNFVDK

SEQ ID NO: 13472 - protein, 15 aa, Homo Sapiens
DKRQWVWGPSGYGGI

SEQ ID NO: 13473 - protein, 15 aa, Homo Sapiens
WVWGPSGYGGILLVN

SEQ ID NO: 13474 - protein, 15 aa, Homo Sapiens
NCDQHVHCLQDLEDM

SEQ ID NO: 13475 - protein, 15 aa, Homo Sapiens
CDQHVHCLQDLEDMS

SEQ ID NO: 13476 - protein, 15 aa, Homo Sapiens
EDMSVMVLRTQGPAA

SEQ ID NO: 13477 - protein, 15 aa, Homo Sapiens
TSSYDAKRAQVFHIC

SEQ ID NO: 13478 - protein, 15 aa, Homo Sapiens
AQVFHICGPEDVCEA

SEQ ID NO: 13479 - protein, 15 aa, Homo Sapiens
DKVSYEVPRLHGDEE

SEQ ID NO: 13480 - protein, 15 aa, Homo Sapiens
EERFFVEGLSFPDAG

SEQ ID NO: 13481 - protein, 15 aa, Homo Sapiens
FPDAGFTGLISFHVT

SEQ ID NO: 13482 - protein, 15 aa, Homo Sapiens
DAGFTGLISFHVTLL

SEQ ID NO: 13483 - protein, 15 aa, Homo Sapiens
LISFHVTLLDDSNED

SEQ ID NO: 13484 - protein, 15 aa, Homo Sapiens
NEDFSASPIFTDTVV

SEQ ID NO: 13485 - protein, 15 aa, Homo Sapiens
SPIFTDTVVFRVAPW

SEQ ID NO: 13486 - protein, 15 aa, Homo Sapiens
IFTDTVVFRVAPWIM

SEQ ID NO: 13487 - protein, 15 aa, Homo Sapiens
LEVYVCRVRNNTCFV

SEQ ID NO: 13488 - protein, 15 aa, Homo Sapiens
DEMELGYVQAPHKTL

SEQ ID NO: 13489 - protein, 15 aa, Homo Sapiens
SPRNGELQDFPYKRI

SEQ ID NO: 13490 - protein, 15 aa, Homo Sapiens
ELQDFPYKRILGPDF

SEQ ID NO: 13491 - protein, 15 aa, Homo Sapiens
LQDFPYKRILGPDFG

SEQ ID NO: 13492 - protein, 15 aa, Homo Sapiens
PRDRSVSGLDSFGNL

SEQ ID NO: 13493 - protein, 15 aa, Homo Sapiens
LDSFGNLEVSPPVVA

SEQ ID NO: 13494 - protein, 15 aa, Homo Sapiens
VSPPVVANGKEYPLG

SEQ ID NO: 13495 - protein, 15 aa, Homo Sapiens
ANGKEYPLGRILIGG

SEQ ID NO: 13496 - protein, 15 aa, Homo Sapiens
NGKEYPLGRILIGGN

SEQ ID NO: 13497 - protein, 15 aa, Homo Sapiens
SGRRVTQVVRDFLHA

SEQ ID NO: 13498 - protein, 15 aa, Homo Sapiens
DWLAVGHVDEFLSFV

SEQ ID NO: 13499 - protein, 15 aa, Homo Sapiens
VPAPDGKGFRMLLAS

SEQ ID NO: 13500 - protein, 15 aa, Homo Sapiens
LLASPGACFKLFQEK

SEQ ID NO: 13501 - protein, 15 aa, Homo Sapiens
SINQVLSNKDLINYN

SEQ ID NO: 13502 - protein, 15 aa, Homo Sapiens
YNKFVQSCIDWNREV

SEQ ID NO: 13503 - protein, 15 aa, Homo Sapiens
DIPQLFKTERKKATA

SEQ ID NO: 13504 - protein, 15 aa, Homo Sapiens
VLGKHLGIPKPFGPI

SEQ ID NO: 13505 - protein, 15 aa, Homo Sapiens
LGKHLGIPKPFGPII

SEQ ID NO: 13506 - protein, 15 aa, Homo Sapiens
NGCCCLEEKVRSLLE

SEQ ID NO: 13507 - protein, 15 aa, Homo Sapiens
TFIDDFTPYHMLHGE

SEQ ID NO: 13508 - protein, 15 aa, Homo Sapiens
TPYHMLHGEVHCGTN

SEQ ID NO: 13509 - protein, 15 aa, Homo Sapiens
SAVCVAGVETLVDIY

SEQ ID NO: 13510 - protein, 15 aa, Homo Sapiens
VDIYGSVPEGTEMFE

SEQ ID NO: 13511 - protein, 15 aa, Homo Sapiens
SVPEGTEMFEVYGTP

SEQ ID NO: 13512 - protein, 15 aa, Homo Sapiens
ISPNMERGRERADTR

SEQ ID NO: 13513 - protein, 15 aa, Homo Sapiens
QISYHSSHEPLPLAY

SEQ ID NO: 13514 - protein, 15 aa, Homo Sapiens
GYGGILLVNCDRDDP

SEQ ID NO: 13515 - protein, 15 aa, Homo Sapiens
VQDNCDQHVHCLQDL

SEQ ID NO: 13516 - protein, 15 aa, Homo Sapiens
HTSSYDAKRAQVFHI

SEQ ID NO: 13517 - protein, 15 aa, Homo Sapiens
QVFHICGPEDVCEAY

SEQ ID NO: 13518 - protein, 15 aa, Homo Sapiens
EAYRHVLGQDKVSYE

SEQ ID NO: 13519 - protein, 15 aa, Homo Sapiens
LGQDKVSYEVPRLHG

SEQ ID NO: 13520 - protein, 15 aa, Homo Sapiens
HGDEERFFVEGLSFP

SEQ ID NO: 13521 - protein, 15 aa, Homo Sapiens
GDEERFFVEGLSFPD

SEQ ID NO: 13522 - protein, 15 aa, Homo Sapiens
DSNEDFSASPIFTDT

SEQ ID NO: 13523 - protein, 15 aa, Homo Sapiens
RVAPWIMTPSTLPPL

SEQ ID NO: 13524 - protein, 15 aa, Homo Sapiens
PPLEVYVCRVRNNTC

SEQ ID NO: 13525 - protein, 15 aa, Homo Sapiens
DAVAELARKAGCKLT

SEQ ID NO: 13526 - protein, 15 aa, Homo Sapiens
ELARKAGCKLTICPQ

SEQ ID NO: 13527 - protein, 15 aa, Homo Sapiens
LTICPQAENRNDRWI

SEQ ID NO: 13528 - protein, 15 aa, Homo Sapiens
VFDSPRNGELQDFPY

SEQ ID NO: 13529 - protein, 15 aa, Homo Sapiens
GLDSFGNLEVSPPVV

SEQ ID NO: 13530 - protein, 15 aa, Homo Sapiens
GNLPGSSGRRVTQVV

SEQ ID NO: 13531 - protein, 15 aa, Homo Sapiens
NLPGSSGRRVTQVVR

SEQ ID NO: 13532 - protein, 15 aa, Homo Sapiens
GSSGRRVTQVVRDFL

SEQ ID NO: 13533 - protein, 15 aa, Homo Sapiens
ALLFQGVVDDEQVKT

SEQ ID NO: 13534 - protein, 15 aa, Homo Sapiens
VLSNKDLINYNKFVQ

SEQ ID NO: 13535 - protein, 15 aa, Homo Sapiens
SNKDLINYNKFVQSC

SEQ ID NO: 13536 - protein, 15 aa, Homo Sapiens
DWNREVLKRELGLAE

SEQ ID NO: 13537 - protein, 15 aa, Homo Sapiens
LKRELGLAECDIIDI

SEQ ID NO: 13538 - protein, 15 aa, Homo Sapiens
LAECDIIDIPQLFKT

SEQ ID NO: 13539 - protein, 15 aa, Homo Sapiens
ERKKATAFFPDLVNM

SEQ ID NO: 13540 - protein, 15 aa, Homo Sapiens
IINGCCCLEEKVRSL

SEQ ID NO: 13541 - protein, 15 aa, Homo Sapiens
IYISPNMERGRERAD

SEQ ID NO: 13542 - protein, 15 aa, Homo Sapiens
ERADTRRWRFDATLE

SEQ ID NO: 13543 - protein, 15 aa, Homo Sapiens
SLDCDLNCEGRQDRN

SEQ ID NO: 13544 - protein, 15 aa, Homo Sapiens
CDLNCEGRQDRNFVD

SEQ ID NO: 13545 - protein, 15 aa, Homo Sapiens
LNCEGRQDRNFVDKR

SEQ ID NO: 13546 - protein, 15 aa, Homo Sapiens
SSYDAKRAQVFHICG

SEQ ID NO: 13547 - protein, 15 aa, Homo Sapiens
ICGPEDVCEAYRHVL

SEQ ID NO: 13548 - protein, 15 aa, Homo Sapiens
PRLHGDEERFFVEGL

SEQ ID NO: 13549 - protein, 15 aa, Homo Sapiens
TICPQAENRNDRWIQ

SEQ ID NO: 13550 - protein, 15 aa, Homo Sapiens
ICPQAENRNDRWIQD

SEQ ID NO: 13551 - protein, 15 aa, Homo Sapiens
DSPRNGELQDFPYKR

SEQ ID NO: 13552 - protein, 15 aa, Homo Sapiens
YVTREPRDRSVSGLD

SEQ ID NO: 13553 - protein, 15 aa, Homo Sapiens
EVSPPVVANGKEYPL

SEQ ID NO: 13554 - protein, 15 aa, Homo Sapiens
VVRDFLHAQKVQPPV

SEQ ID NO: 13555 - protein, 15 aa, Homo Sapiens
LASPGACFKLFQEKQ

SEQ ID NO: 13556 - protein, 15 aa, Homo Sapiens
PGACFKLFQEKQKCG

SEQ ID NO: 13557 - protein, 15 aa, Homo Sapiens
GHGRALLFQGVVDDE

SEQ ID NO: 13558 - protein, 15 aa, Homo Sapiens
GVVDDEQVKTISINQ

SEQ ID NO: 13559 - protein, 15 aa, Homo Sapiens
INGCCCLEEKVRSLL

SEQ ID NO: 13560 - protein, 15 aa, Homo Sapiens
RQDRNFVDKRQWVWG

SEQ ID NO: 13561 - protein, 15 aa, Homo Sapiens
DPSCDVQDNCDQHVH

SEQ ID NO: 13562 - protein, 15 aa, Homo Sapiens
CDVQDNCDQHVHCLQ

SEQ ID NO: 13563 - protein, 15 aa, Homo Sapiens
PQAENRNDRWIQDEM

SEQ ID NO: 13564 - protein, 15 aa, Homo Sapiens
ENRNDRWIQDEMELG

SEQ ID NO: 13565 - protein, 15 aa, Homo Sapiens
PDFGYVTREPRDRSV

SEQ ID NO: 13566 - protein, 15 aa, Homo Sapiens
DFLHAQKVQPPVELF

SEQ ID NO: 13567 - protein, 15 aa, Homo Sapiens
LINYNKFVQSCIDWN

SEQ ID NO: 13568 - protein, 15 aa, Homo Sapiens
HCGTNVCRKPFSFKW

SEQ ID NO: 13569 - protein, 15 aa, Homo Sapiens
VCRKPFSFKWWNMVP

SEQ ID NO: 13570 - protein, 15 aa, Homo Sapiens
VRVSLEHPTSAVCVA

SEQ ID NO: 13571 - protein, 15 aa, Homo Sapiens
GNLEVSPPVVANGKE

SEQ ID NO: 13572 - protein, 15 aa, Homo Sapiens
PLGRILIGGNLPGSS

SEQ ID NO: 13573 - protein, 15 aa, Homo Sapiens
KVRSLLEPLGLHCTF

SEQ ID NO: 13574 - protein, 15 aa, Homo Sapiens
LEHPTSAVCVAGVET

SEQ ID NO: 13575 - protein, 15 aa, Homo Sapiens
FDATLEIIVVMNSPS

SEQ ID NO: 13576 - protein, 15 aa, Homo Sapiens
LVLHTSSYDAKRAQV

SEQ ID NO: 13577 - protein, 15 aa, Homo Sapiens
VAPWIMTPSTLPPLE

SEQ ID NO: 13578 - protein, 15 aa, Homo Sapiens
AGCKLTICPQAENRN

SEQ ID NO: 13579 - protein, 15 aa, Homo Sapiens
EPRDRSVSGLDSFGN

SEQ ID NO: 13580 - protein, 15 aa, Homo Sapiens
SVSGLDSFGNLEVSP

SEQ ID NO: 13581 - protein, 15 aa, Homo Sapiens
SFGNLEVSPPVVANG

SEQ ID NO: 13582 - protein, 15 aa, Homo Sapiens
IGGNLPGSSGRRVTQ

SEQ ID NO: 13583 - protein, 15 aa, Homo Sapiens
PPVELFVDWLAVGHV

SEQ ID NO: 13584 - protein, 15 aa, Homo Sapiens
FVDWLAVGHVDEFLS

SEQ ID NO: 13585 - protein, 15 aa, Homo Sapiens
HGRALLFQGVVDDEQ

SEQ ID NO: 13586 - protein, 15 aa, Homo Sapiens
EVLKRELGLAECDII

SEQ ID NO: 13587 - protein, 15 aa, Homo Sapiens
FFPDLVNMLVLGKHL

SEQ ID NO: 13588 - protein, 15 aa, Homo Sapiens
RIVRVSLEHPTSAVC

SEQ ID NO: 13589 - protein, 15 aa, Homo Sapiens
VSLEHPTSAVCVAGV

SEQ ID NO: 13590 - protein, 15 aa, Homo Sapiens
PGVDIYISPNMERGR

SEQ ID NO: 13591 - protein, 15 aa, Homo Sapiens
RFDATLEIIVVMNSP

SEQ ID NO: 13592 - protein, 15 aa, Homo Sapiens
VVMNSPSNDLNDSHV

SEQ ID NO: 13593 - protein, 15 aa, Homo Sapiens
HSSHEPLPLAYAVLY

SEQ ID NO: 13594 - protein, 15 aa, Homo Sapiens
SSHEPLPLAYAVLYL

SEQ ID NO: 13595 - protein, 15 aa, Homo Sapiens
LAYAVLYLTCVDISL

SEQ ID NO: 13596 - protein, 15 aa, Homo Sapiens
TCVDISLDCDLNCEG

SEQ ID NO: 13597 - protein, 15 aa, Homo Sapiens
VDISLDCDLNCEGRQ

SEQ ID NO: 13598 - protein, 15 aa, Homo Sapiens
LDCDLNCEGRQDRNF

SEQ ID NO: 13599 - protein, 15 aa, Homo Sapiens
WGPSGYGGILLVNCD

SEQ ID NO: 13600 - protein, 15 aa, Homo Sapiens
PSGYGGILLVNCDRD

SEQ ID NO: 13601 - protein, 15 aa, Homo Sapiens
QDLEDMSVMVLRTQG

SEQ ID NO: 13602 - protein, 15 aa, Homo Sapiens
FDDHKLVLHTSSYDA

SEQ ID NO: 13603 - protein, 15 aa, Homo Sapiens
CEAYRHVLGQDKVSY

SEQ ID NO: 13604 - protein, 15 aa, Homo Sapiens
VSYEVPRLHGDEERF

SEQ ID NO: 13605 - protein, 15 aa, Homo Sapiens
YEVPRLHGDEERFFV

SEQ ID NO: 13606 - protein, 15 aa, Homo Sapiens
WIMTPSTLPPLEVYV

SEQ ID NO: 13607 - protein, 15 aa, Homo Sapiens
TLPPLEVYVCRVRNN

SEQ ID NO: 13608 - protein, 15 aa, Homo Sapiens
FVDAVAELARKAGCK

SEQ ID NO: 13609 - protein, 15 aa, Homo Sapiens
AVAELARKAGCKLTI

SEQ ID NO: 13610 - protein, 15 aa, Homo Sapiens
AELARKAGCKLTICP

SEQ ID NO: 13611 - protein, 15 aa, Homo Sapiens
IQDEMELGYVQAPHK

SEQ ID NO: 13612 - protein, 15 aa, Homo Sapiens
GYVQAPHKTLPVVFD

SEQ ID NO: 13613 - protein, 15 aa, Homo Sapiens
QAPHKTLPVVFDSPR

SEQ ID NO: 13614 - protein, 15 aa, Homo Sapiens
PHKTLPVVFDSPRNG

SEQ ID NO: 13615 - protein, 15 aa, Homo Sapiens
RDRSVSGLDSFGNLE

SEQ ID NO: 13616 - protein, 15 aa, Homo Sapiens
VANGKEYPLGRILIG

SEQ ID NO: 13617 - protein, 15 aa, Homo Sapiens
APDGKGFRMLLASPG

SEQ ID NO: 13618 - protein, 15 aa, Homo Sapiens
CGHGRALLFQGVVDD

SEQ ID NO: 13619 - protein, 15 aa, Homo Sapiens
SCIDWNREVLKRELG

SEQ ID NO: 13620 - protein, 15 aa, Homo Sapiens
DIIDIPQLFKTERKK

SEQ ID NO: 13621 - protein, 15 aa, Homo Sapiens
LVLGKHLGIPKPFGP

SEQ ID NO: 13622 - protein, 15 aa, Homo Sapiens
KHLGIPKPFGPIING

SEQ ID NO: 13623 - protein, 15 aa, Homo Sapiens
LGIPKPFGPIINGCC

SEQ ID NO: 13624 - protein, 15 aa, Homo Sapiens
CLEEKVRSLLEPLGL

SEQ ID NO: 13625 - protein, 15 aa, Homo Sapiens
LHGEVHCGTNVCRKP

SEQ ID NO: 13626 - protein, 15 aa, Homo Sapiens
NVCRKPFSFKWWNMV

SEQ ID NO: 13627 - protein, 15 aa, Homo Sapiens
MSLQRIVRVSLEHPT

SEQ ID NO: 13628 - protein, 15 aa, Homo Sapiens
SLQRIVRVSLEHPTS

SEQ ID NO: 13629 - protein, 15 aa, Homo Sapiens
PTSAVCVAGVETLVD

SEQ ID NO: 13630 - protein, 15 aa, Homo Sapiens
AGVETLVDIYGSVPE

SEQ ID NO: 13631 - protein, 15 aa, Homo Sapiens
TLVDIYGSVPEGTEM

SEQ ID NO: 13632 - protein, 15 aa, Homo Sapiens
PEGTEMFEVYGTPGV

SEQ ID NO: 13633 - protein, 15 aa, Homo Sapiens
EVYGTPGVDIYISPN

SEQ ID NO: 13634 - protein, 15 aa, Homo Sapiens
VDIYISPNMERGRER

SEQ ID NO: 13635 - protein, 15 aa, Homo Sapiens
MERGRERADTRRWRF

SEQ ID NO: 13636 - protein, 15 aa, Homo Sapiens
RADTRRWRFDATLEI

SEQ ID NO: 13637 - protein, 15 aa, Homo Sapiens
ATLEIIVVMNSPSND

SEQ ID NO: 13638 - protein, 15 aa, Homo Sapiens
VMNSPSNDLNDSHVQ

SEQ ID NO: 13639 - protein, 15 aa, Homo Sapiens
NDSHVQISYHSSHEP

SEQ ID NO: 13640 - protein, 15 aa, Homo Sapiens
SHVQISYHSSHEPLP

SEQ ID NO: 13641 - protein, 15 aa, Homo Sapiens
SYHSSHEPLPLAYAV

SEQ ID NO: 13642 - protein, 15 aa, Homo Sapiens
LPLAYAVLYLTCVDI

SEQ ID NO: 13643 - protein, 15 aa, Homo Sapiens
YLTCVDISLDCDLNC

SEQ ID NO: 13644 - protein, 15 aa, Homo Sapiens
KRQWVWGPSGYGGIL

SEQ ID NO: 13645 - protein, 15 aa, Homo Sapiens
QWVWGPSGYGGILLV

SEQ ID NO: 13646 - protein, 15 aa, Homo Sapiens
SGYGGILLVNCDRDD

SEQ ID NO: 13647 - protein, 15 aa, Homo Sapiens
CDRDDPSCDVQDNCD

SEQ ID NO: 13648 - protein, 15 aa, Homo Sapiens
DRDDPSCDVQDNCDQ

SEQ ID NO: 13649 - protein, 15 aa, Homo Sapiens
DLEDMSVMVLRTQGP

SEQ ID NO: 13650 - protein, 15 aa, Homo Sapiens
ALFDDHKLVLHTSSY

SEQ ID NO: 13651 - protein, 15 aa, Homo Sapiens
EDVCEAYRHVLGQDK

SEQ ID NO: 13652 - protein, 15 aa, Homo Sapiens
AYRHVLGQDKVSYEV

SEQ ID NO: 13653 - protein, 15 aa, Homo Sapiens
LHGDEERFFVEGLSF

SEQ ID NO: 13654 - protein, 15 aa, Homo Sapiens
FFVEGLSFPDAGFTG

SEQ ID NO: 13655 - protein, 15 aa, Homo Sapiens
AGFTGLISFHVTLLD

SEQ ID NO: 13656 - protein, 15 aa, Homo Sapiens
ISFHVTLLDDSNEDF

SEQ ID NO: 13657 - protein, 15 aa, Homo Sapiens
TLLDDSNEDFSASPI

SEQ ID NO: 13658 - protein, 15 aa, Homo Sapiens
SNEDFSASPIFTDTV

SEQ ID NO: 13659 - protein, 15 aa, Homo Sapiens
FTDTVVFRVAPWIMT

SEQ ID NO: 13660 - protein, 15 aa, Homo Sapiens
IMTPSTLPPLEVYVC

SEQ ID NO: 13661 - protein, 15 aa, Homo Sapiens
STLPPLEVYVCRVRN

SEQ ID NO: 13662 - protein, 15 aa, Homo Sapiens
VRNNTCFVDAVAELA

SEQ ID NO: 13663 - protein, 15 aa, Homo Sapiens
RNNTCFVDAVAELAR

SEQ ID NO: 13664 - protein, 15 aa, Homo Sapiens
CFVDAVAELARKAGC

SEQ ID NO: 13665 - protein, 15 aa, Homo Sapiens
KAGCKLTICPQAENR

SEQ ID NO: 13666 - protein, 15 aa, Homo Sapiens
CKLTICPQAENRNDR

SEQ ID NO: 13667 - protein, 15 aa, Homo Sapiens
RWIQDEMELGYVQAP

SEQ ID NO: 13668 - protein, 15 aa, Homo Sapiens
WIQDEMELGYVQAPH

SEQ ID NO: 13669 - protein, 15 aa, Homo Sapiens
APHKTLPVVFDSPRN

SEQ ID NO: 13670 - protein, 15 aa, Homo Sapiens
VVFDSPRNGELQDFP

SEQ ID NO: 13671 - protein, 15 aa, Homo Sapiens
FPYKRILGPDFGYVT

SEQ ID NO: 13672 - protein, 15 aa, Homo Sapiens
RILGPDFGYVTREPR

SEQ ID NO: 13673 - protein, 15 aa, Homo Sapiens
DFGYVTREPRDRSVS

SEQ ID NO: 13674 - protein, 15 aa, Homo Sapiens
GYVTREPRDRSVSGL

SEQ ID NO: 13675 - protein, 15 aa, Homo Sapiens
LEVSPPVVANGKEYP

SEQ ID NO: 13676 - protein, 15 aa, Homo Sapiens
PVVANGKEYPLGRIL

SEQ ID NO: 13677 - protein, 15 aa, Homo Sapiens
GKEYPLGRILIGGNL

SEQ ID NO: 13678 - protein, 15 aa, Homo Sapiens
KEYPLGRILIGGNLP

SEQ ID NO: 13679 - protein, 15 aa, Homo Sapiens
LIGGNLPGSSGRRVT

SEQ ID NO: 13680 - protein, 15 aa, Homo Sapiens
SSGRRVTQVVRDFLH

SEQ ID NO: 13681 - protein, 15 aa, Homo Sapiens
RVTQVVRDFLHAQKV

SEQ ID NO: 13682 - protein, 15 aa, Homo Sapiens
QVVRDFLHAQKVQPP

SEQ ID NO: 13683 - protein, 15 aa, Homo Sapiens
QKVQPPVELFVDWLA

SEQ ID NO: 13684 - protein, 15 aa, Homo Sapiens
KVQPPVELFVDWLAV

SEQ ID NO: 13685 - protein, 15 aa, Homo Sapiens
GHVDEFLSFVPAPDG

SEQ ID NO: 13686 - protein, 15 aa, Homo Sapiens
HVDEFLSFVPAPDGK

SEQ ID NO: 13687 - protein, 15 aa, Homo Sapiens
PDGKGFRMLLASPGA

SEQ ID NO: 13688 - protein, 15 aa, Homo Sapiens
DGKGFRMLLASPGAC

SEQ ID NO: 13689 - protein, 15 aa, Homo Sapiens
SPGACFKLFQEKQKC

SEQ ID NO: 13690 - protein, 15 aa, Homo Sapiens
DDEQVKTISINQVLS

SEQ ID NO: 13691 - protein, 15 aa, Homo Sapiens
KTISINQVLSNKDLI

SEQ ID NO: 13692 - protein, 15 aa, Homo Sapiens
VLKRELGLAECDIID

SEQ ID NO: 13693 - protein, 15 aa, Homo Sapiens
RELGLAECDIIDIPQ

SEQ ID NO: 13694 - protein, 15 aa, Homo Sapiens
IDIPQLFKTERKKAT

SEQ ID NO: 13695 - protein, 15 aa, Homo Sapiens
RKKATAFFPDLVNML

SEQ ID NO: 13696 - protein, 15 aa, Homo Sapiens
KKATAFFPDLVNMLV

SEQ ID NO: 13697 - protein, 15 aa, Homo Sapiens
KATAFFPDLVNMLVL

SEQ ID NO: 13698 - protein, 15 aa, Homo Sapiens
GIPKPFGPIINGCCC

SEQ ID NO: 13699 - protein, 15 aa, Homo Sapiens
CCLEEKVRSLLEPLG

SEQ ID NO: 13700 - protein, 15 aa, Homo Sapiens
LLEPLGLHCTFIDDF

SEQ ID NO: 13701 - protein, 15 aa, Homo Sapiens
EPLGLHCTFIDDFTP

SEQ ID NO: 13702 - protein, 15 aa, Homo Sapiens
TNVCRKPFSFKWWNM

SEQ ID NO: 13703 - protein, 15 aa, Homo Sapiens
EHPTSAVCVAGVETL

SEQ ID NO: 13704 - protein, 15 aa, Homo Sapiens
VCVAGVETLVDIYGS

SEQ ID NO: 13705 - protein, 15 aa, Homo Sapiens
DIYGSVPEGTEMFEV

SEQ ID NO: 13706 - protein, 15 aa, Homo Sapiens
GSVPEGTEMFEVYGT

SEQ ID NO: 13707 - protein, 15 aa, Homo Sapiens
EMFEVYGTPGVDIYI

SEQ ID NO: 13708 - protein, 15 aa, Homo Sapiens
GTPGVDIYISPNMER

SEQ ID NO: 13709 - protein, 15 aa, Homo Sapiens
YISPNMERGRERADT

SEQ ID NO: 13710 - protein, 15 aa, Homo Sapiens
DTRRWRFDATLEIIV

SEQ ID NO: 13711 - protein, 15 aa, Homo Sapiens
WRFDATLEIIVVMNS

SEQ ID NO: 13712 - protein, 15 aa, Homo Sapiens
SPSNDLNDSHVQISY

SEQ ID NO: 13713 - protein, 15 aa, Homo Sapiens
CEGRQDRNFVDKRQW

SEQ ID NO: 13714 - protein, 15 aa, Homo Sapiens
EGRQDRNFVDKRQWV

SEQ ID NO: 13715 - protein, 15 aa, Homo Sapiens
GRQDRNFVDKRQWVW

SEQ ID NO: 13716 - protein, 15 aa, Homo Sapiens
NFVDKRQWVWGPSGY

SEQ ID NO: 13717 - protein, 15 aa, Homo Sapiens
FVDKRQWVWGPSGYG

SEQ ID NO: 13718 - protein, 15 aa, Homo Sapiens
GPSGYGGILLVNCDR

SEQ ID NO: 13719 - protein, 15 aa, Homo Sapiens
NCDRDDPSCDVQDNC

SEQ ID NO: 13720 - protein, 15 aa, Homo Sapiens
DDPSCDVQDNCDQHV

SEQ ID NO: 13721 - protein, 15 aa, Homo Sapiens
QDNCDQHVHCLQDLE

SEQ ID NO: 13722 - protein, 15 aa, Homo Sapiens
DNCDQHVHCLQDLED

SEQ ID NO: 13723 - protein, 15 aa, Homo Sapiens
QHVHCLQDLEDMSVM

SEQ ID NO: 13724 - protein, 15 aa, Homo Sapiens
HCLQDLEDMSVMVLR

SEQ ID NO: 13725 - protein, 15 aa, Homo Sapiens
VLRTQGPAALFDDHK

SEQ ID NO: 13726 - protein, 15 aa, Homo Sapiens
LRTQGPAALFDDHKL

SEQ ID NO: 13727 - protein, 15 aa, Homo Sapiens
RTQGPAALFDDHKLV

SEQ ID NO: 13728 - protein, 15 aa, Homo Sapiens
VLHTSSYDAKRAQVF

SEQ ID NO: 13729 - protein, 15 aa, Homo Sapiens
SYDAKRAQVFHICGP

SEQ ID NO: 13730 - protein, 15 aa, Homo Sapiens
YDAKRAQVFHICGPE

SEQ ID NO: 13731 - protein, 15 aa, Homo Sapiens
KRAQVFHICGPEDVC

SEQ ID NO: 13732 - protein, 15 aa, Homo Sapiens
FHICGPEDVCEAYRH

SEQ ID NO: 13733 - protein, 15 aa, Homo Sapiens
CGPEDVCEAYRHVLG

SEQ ID NO: 13734 - protein, 15 aa, Homo Sapiens
GPEDVCEAYRHVLGQ

SEQ ID NO: 13735 - protein, 15 aa, Homo Sapiens
DVCEAYRHVLGQDKV

SEQ ID NO: 13736 - protein, 15 aa, Homo Sapiens
VLGQDKVSYEVPRLH

SEQ ID NO: 13737 - protein, 15 aa, Homo Sapiens
RLHGDEERFFVEGLS

SEQ ID NO: 13738 - protein, 15 aa, Homo Sapiens
LSFPDAGFTGLISFH

SEQ ID NO: 13739 - protein, 15 aa, Homo Sapiens
SFPDAGFTGLISFHV

SEQ ID NO: 13740 - protein, 15 aa, Homo Sapiens
PDAGFTGLISFHVTL

SEQ ID NO: 13741 - protein, 15 aa, Homo Sapiens
GLISFHVTLLDDSNE

SEQ ID NO: 13742 - protein, 15 aa, Homo Sapiens
LLDDSNEDFSASPIF

SEQ ID NO: 13743 - protein, 15 aa, Homo Sapiens
DDSNEDFSASPIFTD

SEQ ID NO: 13744 - protein, 15 aa, Homo Sapiens
EDFSASPIFTDTVVF

SEQ ID NO: 13745 - protein, 15 aa, Homo Sapiens
DFSASPIFTDTVVFR

SEQ ID NO: 13746 - protein, 15 aa, Homo Sapiens
VVFRVAPWIMTPSTL

SEQ ID NO: 13747 - protein, 15 aa, Homo Sapiens
YVCRVRNNTCFVDAV

SEQ ID NO: 13748 - protein, 15 aa, Homo Sapiens
CRVRNNTCFVDAVAE

SEQ ID NO: 13749 - protein, 15 aa, Homo Sapiens
RVRNNTCFVDAVAEL

SEQ ID NO: 13750 - protein, 15 aa, Homo Sapiens
LARKAGCKLTICPQA

SEQ ID NO: 13751 - protein, 15 aa, Homo Sapiens
ARKAGCKLTICPQAE

SEQ ID NO: 13752 - protein, 15 aa, Homo Sapiens
AENRNDRWIQDEMEL

SEQ ID NO: 13753 - protein, 15 aa, Homo Sapiens
NRNDRWIQDEMELGY

SEQ ID NO: 13754 - protein, 15 aa, Homo Sapiens
MELGYVQAPHKTLPV

SEQ ID NO: 13755 - protein, 15 aa, Homo Sapiens
KTLPVVFDSPRNGEL

SEQ ID NO: 13756 - protein, 15 aa, Homo Sapiens
PRNGELQDFPYKRIL

SEQ ID NO: 13757 - protein, 15 aa, Homo Sapiens
REPRDRSVSGLDSFG

SEQ ID NO: 13758 - protein, 15 aa, Homo Sapiens
DSFGNLEVSPPVVAN

SEQ ID NO: 13759 - protein, 15 aa, Homo Sapiens
VVANGKEYPLGRILI

SEQ ID NO: 13760 - protein, 15 aa, Homo Sapiens
ILIGGNLPGSSGRRV

SEQ ID NO: 13761 - protein, 15 aa, Homo Sapiens
PGSSGRRVTQVVRDF

SEQ ID NO: 13762 - protein, 15 aa, Homo Sapiens
RRVTQVVRDFLHAQK

SEQ ID NO: 13763 - protein, 15 aa, Homo Sapiens
LFVDWLAVGHVDEFL

SEQ ID NO: 13764 - protein, 15 aa, Homo Sapiens
AVGHVDEFLSFVPAP

SEQ ID NO: 13765 - protein, 15 aa, Homo Sapiens
FVPAPDGKGFRMLLA

SEQ ID NO: 13766 - protein, 15 aa, Homo Sapiens
KGFRMLLASPGACFK

SEQ ID NO: 13767 - protein, 15 aa, Homo Sapiens
ASPGACFKLFQEKQK

SEQ ID NO: 13768 - protein, 15 aa, Homo Sapiens
KLFQEKQKCGHGRAL

SEQ ID NO: 13769 - protein, 15 aa, Homo Sapiens
LFQEKQKCGHGRALL

SEQ ID NO: 13770 - protein, 15 aa, Homo Sapiens
FQEKQKCGHGRALLF

SEQ ID NO: 13771 - protein, 15 aa, Homo Sapiens
QKCGHGRALLFQGVV

SEQ ID NO: 13772 - protein, 15 aa, Homo Sapiens
KCGHGRALLFQGVVD

SEQ ID NO: 13773 - protein, 15 aa, Homo Sapiens
VVDDEQVKTISINQV

SEQ ID NO: 13774 - protein, 15 aa, Homo Sapiens
DLINYNKFVQSCIDW

SEQ ID NO: 13775 - protein, 15 aa, Homo Sapiens
INYNKFVQSCIDWNR

SEQ ID NO: 13776 - protein, 15 aa, Homo Sapiens
NYNKFVQSCIDWNRE

SEQ ID NO: 13777 - protein, 15 aa, Homo Sapiens
KFVQSCIDWNREVLK

SEQ ID NO: 13778 - protein, 15 aa, Homo Sapiens
KTERKKATAFFPDLV

SEQ ID NO: 13779 - protein, 15 aa, Homo Sapiens
TERKKATAFFPDLVN

SEQ ID NO: 13780 - protein, 15 aa, Homo Sapiens
IPKPFGPIINGCCCL

SEQ ID NO: 13781 - protein, 15 aa, Homo Sapiens
GLHCTFIDDFTPYHM

SEQ ID NO: 13782 - protein, 15 aa, Homo Sapiens
FIDDFTPYHMLHGEV

SEQ ID NO: 13783 - protein, 15 aa, Homo Sapiens
DFTPYHMLHGEVHCG

SEQ ID NO: 13784 - protein, 15 aa, Homo Sapiens
FTPYHMLHGEVHCGT

SEQ ID NO: 13785 - protein, 15 aa, Homo Sapiens
HMLHGEVHCGTNVCR

SEQ ID NO: 13786 - protein, 15 aa, Homo Sapiens
MLHGEVHCGTNVCRK

SEQ ID NO: 13787 - protein, 15 aa, Homo Sapiens
EVHCGTNVCRKPFSF

SEQ ID NO: 13788 - protein, 15 aa, Homo Sapiens
PWIMTPSTLAPLEVY

SEQ ID NO: 13789 - protein, 15 aa, Homo Sapiens
APWIMTPSTLAPLEV

SEQ ID NO: 13790 - protein, 15 aa, Homo Sapiens
PSTLAPLEVYVCRVR

SEQ ID NO: 13791 - protein, 15 aa, Homo Sapiens
VFRVAPWIMTPSTLA

SEQ ID NO: 13792 - protein, 15 aa, Homo Sapiens
MTPSTLAPLEVYVCR

SEQ ID NO: 13793 - protein, 15 aa, Homo Sapiens
TPSTLAPLEVYVCRV

SEQ ID NO: 13794 - protein, 15 aa, Homo Sapiens
LAPLEVYVCRVRNNT

SEQ ID NO: 13795 - protein, 15 aa, Homo Sapiens
RVAPWIMTPSTLAPL

SEQ ID NO: 13796 - protein, 15 aa, Homo Sapiens
APLEVYVCRVRNNTC

SEQ ID NO: 13797 - protein, 15 aa, Homo Sapiens
VAPWIMTPSTLAPLE

SEQ ID NO: 13798 - protein, 15 aa, Homo Sapiens
WIMTPSTLAPLEVYV

SEQ ID NO: 13799 - protein, 15 aa, Homo Sapiens
TLAPLEVYVCRVRNN

SEQ ID NO: 13800 - protein, 15 aa, Homo Sapiens
STLAPLEVYVCRVRN

SEQ ID NO: 13801 - protein, 15 aa, Homo Sapiens
IMTPSTLAPLEVYVC

SEQ ID NO: 13802 - protein, 15 aa, Homo Sapiens
LAVGHVDEFLSFVPV

SEQ ID NO: 13803 - protein, 15 aa, Homo Sapiens
SFVPVPDGKGFRMLL

SEQ ID NO: 13804 - protein, 15 aa, Homo Sapiens
LSFVPVPDGKGFRML

SEQ ID NO: 13805 - protein, 15 aa, Homo Sapiens
PVPDGKGFRMLLASP

SEQ ID NO: 13806 - protein, 15 aa, Homo Sapiens
VGHVDEFLSFVPVPD

SEQ ID NO: 13807 - protein, 15 aa, Homo Sapiens
VDEFLSFVPVPDGKG

SEQ ID NO: 13808 - protein, 15 aa, Homo Sapiens
FLSFVPVPDGKGFRM

SEQ ID NO: 13809 - protein, 15 aa, Homo Sapiens
DEFLSFVPVPDGKGF

SEQ ID NO: 13810 - protein, 15 aa, Homo Sapiens
FVPVPDGKGFRMLLA

SEQ ID NO: 13811 - protein, 15 aa, Homo Sapiens
VPVPDGKGFRMLLAS

SEQ ID NO: 13812 - protein, 15 aa, Homo Sapiens
VPDGKGFRMLLASPG

SEQ ID NO: 13813 - protein, 15 aa, Homo Sapiens
GHVDEFLSFVPVPDG

SEQ ID NO: 13814 - protein, 15 aa, Homo Sapiens
AVGHVDEFLSFVPVP

SEQ ID NO: 13815 - protein, 15 aa, Homo Sapiens
HVDEFLSFVPVPDGK

SEQ ID NO: 13816 - protein, 15 aa, Homo Sapiens
TRRWRFDATLEIIVV

SEQ ID NO: 13817 - protein, 15 aa, Homo Sapiens
DAGFTGLISFHVTLL

SEQ ID NO: 13818 - protein, 15 aa, Homo Sapiens
ELGYVQAPHKTLPVV

SEQ ID NO: 13819 - protein, 15 aa, Homo Sapiens
LINYNKFVQSCIDWN

SEQ ID NO: 13820 - protein, 15 aa, Homo Sapiens
TAFFPDLVNMLVLGK

SEQ ID NO: 13821 - protein, 15 aa, Homo Sapiens
TLEIIVVMNSPSNDL

SEQ ID NO: 13822 - protein, 15 aa, Homo Sapiens
PEDVCEAYRHVLGQD

SEQ ID NO: 13823 - protein, 15 aa, Homo Sapiens
FGYVTREPRDRSVSG

SEQ ID NO: 13824 - protein, 15 aa, Homo Sapiens
DRSVSGLDSFGNLEV

SEQ ID NO: 13825 - protein, 15 aa, Homo Sapiens
VSGLDSFGNLEVSPP

SEQ ID NO: 13826 - protein, 15 aa, Homo Sapiens
GRRVTQVVRDFLHAQ

SEQ ID NO: 13827 - protein, 15 aa, Homo Sapiens
TQVVRDFLHAQKVQP

SEQ ID NO: 13828 - protein, 15 aa, Homo Sapiens
FQGVVDDEQVKTISI

SEQ ID NO: 13829 - protein, 15 aa, Homo Sapiens
ECDIIDIPQLFKTER

SEQ ID NO: 13830 - protein, 15 aa, Homo Sapiens
YHMLHGEVHCGTNVC

SEQ ID NO: 13831 - protein, 15 aa, Homo Sapiens
TEMFEVYGTPGVDIY

SEQ ID NO: 13832 - protein, 15 aa, Homo Sapiens
PLAYAVLYLTCVDIS

SEQ ID NO: 13833 - protein, 15 aa, Homo Sapiens
CEAYRHVLGQDKVSY

SEQ ID NO: 13834 - protein, 15 aa, Homo Sapiens
GLSFPDAGFTGLISF

SEQ ID NO: 13835 - protein, 15 aa, Homo Sapiens
TVVFRVAPWIMTPST

SEQ ID NO: 13836 - protein, 15 aa, Homo Sapiens
NTCFVDAVAELARKA

SEQ ID NO: 13837 - protein, 15 aa, Homo Sapiens
PVVFDSPRNGELQDF

SEQ ID NO: 13838 - protein, 15 aa, Homo Sapiens
GPDFGYVTREPRDRS

SEQ ID NO: 13839 - protein, 15 aa, Homo Sapiens
FVDWLAVGHVDEFLS

SEQ ID NO: 13840 - protein, 15 aa, Homo Sapiens
GACFKLFQEKQKCGH

SEQ ID NO: 13841 - protein, 15 aa, Homo Sapiens
ALLFQGVVDDEQVKT

SEQ ID NO: 13842 - protein, 15 aa, Homo Sapiens
PQLFKTERKKATAFF

SEQ ID NO: 13843 - protein, 15 aa, Homo Sapiens
ATAFFPDLVNMLVLG

SEQ ID NO: 13844 - protein, 15 aa, Homo Sapiens
PKPFGPIINGCCCLE

SEQ ID NO: 13845 - protein, 15 aa, Homo Sapiens
HCTFIDDFTPYHMLH

SEQ ID NO: 13846 - protein, 15 aa, Homo Sapiens
IVRVSLEHPTSAVCV

SEQ ID NO: 13847 - protein, 15 aa, Homo Sapiens
TSAVCVAGVETLVDI

SEQ ID NO: 13848 - protein, 15 aa, Homo Sapiens
AVCVAGVETLVDIYG

SEQ ID NO: 13849 - protein, 15 aa, Homo Sapiens
TPGVDIYISPNMERG

SEQ ID NO: 13850 - protein, 15 aa, Homo Sapiens
DATLEIIVVMNSPSN

SEQ ID NO: 13851 - protein, 15 aa, Homo Sapiens
LEIIVVMNSPSNDLN

SEQ ID NO: 13852 - protein, 15 aa, Homo Sapiens
IIVVMNSPSNDLNDS

SEQ ID NO: 13853 - protein, 15 aa, Homo Sapiens
IVVMNSPSNDLNDSH

SEQ ID NO: 13854 - protein, 15 aa, Homo Sapiens
PLPLAYAVLYLTCVD

SEQ ID NO: 13855 - protein, 15 aa, Homo Sapiens
AYAVLYLTCVDISLD

SEQ ID NO: 13856 - protein, 15 aa, Homo Sapiens
DISLDCDLNCEGRQD

SEQ ID NO: 13857 - protein, 15 aa, Homo Sapiens
DCDLNCEGRQDRNFV

SEQ ID NO: 13858 - protein, 15 aa, Homo Sapiens
ILLVNCDRDDPSCDV

SEQ ID NO: 13859 - protein, 15 aa, Homo Sapiens
VHCLQDLEDMSVMVL

SEQ ID NO: 13860 - protein, 15 aa, Homo Sapiens
DMSVMVLRTQGPAAL

SEQ ID NO: 13861 - protein, 15 aa, Homo Sapiens
PAALFDDHKLVLHTS

SEQ ID NO: 13862 - protein, 15 aa, Homo Sapiens
HKLVLHTSSYDAKRA

SEQ ID NO: 13863 - protein, 15 aa, Homo Sapiens
RFFVEGLSFPDAGFT

SEQ ID NO: 13864 - protein, 15 aa, Homo Sapiens
FTGLISFHVTLLDDS

SEQ ID NO: 13865 - protein, 15 aa, Homo Sapiens
HVTLLDDSNEDFSAS

SEQ ID NO: 13866 - protein, 15 aa, Homo Sapiens
DTVVFRVAPWIMTPS

SEQ ID NO: 13867 - protein, 15 aa, Homo Sapiens
EVYVCRVRNNTCFVD

SEQ ID NO: 13868 - protein, 15 aa, Homo Sapiens
VDAVAELARKAGCKL

SEQ ID NO: 13869 - protein, 15 aa, Homo Sapiens
GCKLTICPQAENRND

SEQ ID NO: 13870 - protein, 15 aa, Homo Sapiens
EMELGYVQAPHKTLP

SEQ ID NO: 13871 - protein, 15 aa, Homo Sapiens
NGELQDFPYKRILGP

SEQ ID NO: 13872 - protein, 15 aa, Homo Sapiens
KRILGPDFGYVTREP

SEQ ID NO: 13873 - protein, 15 aa, Homo Sapiens
EYPLGRILIGGNLPG

SEQ ID NO: 13874 - protein, 15 aa, Homo Sapiens
VTQVVRDFLHAQKVQ

SEQ ID NO: 13875 - protein, 15 aa, Homo Sapiens
QPPVELFVDWLAVGH

SEQ ID NO: 13876 - protein, 15 aa, Homo Sapiens
ELFVDWLAVGHVDEF

SEQ ID NO: 13877 - protein, 15 aa, Homo Sapiens
WLAVGHVDEFLSFVP

SEQ ID NO: 13878 - protein, 15 aa, Homo Sapiens
VGHVDEFLSFVPAPD

SEQ ID NO: 13879 - protein, 15 aa, Homo Sapiens
CFKLFQEKQKCGHGR

SEQ ID NO: 13880 - protein, 15 aa, Homo Sapiens
QGVVDDEQVKTISIN

SEQ ID NO: 13881 - protein, 15 aa, Homo Sapiens
DEQVKTISINQVLSN

SEQ ID NO: 13882 - protein, 15 aa, Homo Sapiens
TISINQVLSNKDLIN

SEQ ID NO: 13883 - protein, 15 aa, Homo Sapiens
KRELGLAECDIIDIP

SEQ ID NO: 13884 - protein, 15 aa, Homo Sapiens
IPQLFKTERKKATAF

SEQ ID NO: 13885 - protein, 15 aa, Homo Sapiens
VNMLVLGKHLGIPKP

SEQ ID NO: 13886 - protein, 15 aa, Homo Sapiens
RSLLEPLGLHCTFID

SEQ ID NO: 13887 - protein, 15 aa, Homo Sapiens
CTFIDDFTPYHMLHG

SEQ ID NO: 13888 - protein, 15 aa, Homo Sapiens
RIVRVSLEHPTSAVC

SEQ ID NO: 13889 - protein, 15 aa, Homo Sapiens
PSNDLNDSHVQISYH

SEQ ID NO: 13890 - protein, 15 aa, Homo Sapiens
QDRNFVDKRQWVWGP

SEQ ID NO: 13891 - protein, 15 aa, Homo Sapiens
VNCDRDDPSCDVQDN

SEQ ID NO: 13892 - protein, 15 aa, Homo Sapiens
CLQDLEDMSVMVLRT

SEQ ID NO: 13893 - protein, 15 aa, Homo Sapiens
GPAALFDDHKLVLHT

SEQ ID NO: 13894 - protein, 15 aa, Homo Sapiens
FDDHKLVLHTSSYDA

SEQ ID NO: 13895 - protein, 15 aa, Homo Sapiens
HTSSYDAKRAQVFHI

SEQ ID NO: 13896 - protein, 15 aa, Homo Sapiens
EAYRHVLGQDKVSYE

SEQ ID NO: 13897 - protein, 15 aa, Homo Sapiens
PRLHGDEERFFVEGL

SEQ ID NO: 13898 - protein, 15 aa, Homo Sapiens
DFSASPIFTDTVVFR

SEQ ID NO: 13899 - protein, 15 aa, Homo Sapiens
FRVAPWIMTPSTLPP

SEQ ID NO: 13900 - protein, 15 aa, Homo Sapiens
PPLEVYVCRVRNNTC

SEQ ID NO: 13901 - protein, 15 aa, Homo Sapiens
KTLPVVFDSPRNGEL

SEQ ID NO: 13902 - protein, 15 aa, Homo Sapiens
DSFGNLEVSPPVVAN

SEQ ID NO: 13903 - protein, 15 aa, Homo Sapiens
NGKEYPLGRILIGGN

SEQ ID NO: 13904 - protein, 15 aa, Homo Sapiens
KGFRMLLASPGACFK

SEQ ID NO: 13905 - protein, 15 aa, Homo Sapiens
PGACFKLFQEKQKCG

SEQ ID NO: 13906 - protein, 15 aa, Homo Sapiens
GHGRALLFQGVVDDE

SEQ ID NO: 13907 - protein, 15 aa, Homo Sapiens
VVDDEQVKTISINQV

SEQ ID NO: 13908 - protein, 15 aa, Homo Sapiens
QVKTISINQVLSNKD

SEQ ID NO: 13909 - protein, 15 aa, Homo Sapiens
ISINQVLSNKDLINY

SEQ ID NO: 13910 - protein, 15 aa, Homo Sapiens
VLSNKDLINYNKFVQ

SEQ ID NO: 13911 - protein, 15 aa, Homo Sapiens
FVQSCIDWNREVLKR

SEQ ID NO: 13912 - protein, 15 aa, Homo Sapiens
IDIPQLFKTERKKAT

SEQ ID NO: 13913 - protein, 15 aa, Homo Sapiens
LEVYVCRVRNNTCFV

SEQ ID NO: 13914 - protein, 15 aa, Homo Sapiens
VDIYGSVPEGTEMFE

SEQ ID NO: 13915 - protein, 15 aa, Homo Sapiens
RWRFDATLEIIVVMN

SEQ ID NO: 13916 - protein, 15 aa, Homo Sapiens
AVLYLTCVDISLDCD

SEQ ID NO: 13917 - protein, 15 aa, Homo Sapiens
KRQWVWGPSGYGGIL

SEQ ID NO: 13918 - protein, 15 aa, Homo Sapiens
QWVWGPSGYGGILLV

SEQ ID NO: 13919 - protein, 15 aa, Homo Sapiens
PSGYGGILLVNCDRD

SEQ ID NO: 13920 - protein, 15 aa, Homo Sapiens
AQVFHICGPEDVCEA

SEQ ID NO: 13921 - protein, 15 aa, Homo Sapiens
EERFFVEGLSFPDAG

SEQ ID NO: 13922 - protein, 15 aa, Homo Sapiens
ERFFVEGLSFPDAGF

SEQ ID NO: 13923 - protein, 15 aa, Homo Sapiens
LISFHVTLLDDSNED

SEQ ID NO: 13924 - protein, 15 aa, Homo Sapiens
SPIFTDTVVFRVAPW

SEQ ID NO: 13925 - protein, 15 aa, Homo Sapiens
VAPWIMTPSTLPPLE

SEQ ID NO: 13926 - protein, 15 aa, Homo Sapiens
NDRWIQDEMELGYVQ

SEQ ID NO: 13927 - protein, 15 aa, Homo Sapiens
DFPYKRILGPDFGYV

SEQ ID NO: 13928 - protein, 15 aa, Homo Sapiens
LDSFGNLEVSPPVVA

SEQ ID NO: 13929 - protein, 15 aa, Homo Sapiens
VRDFLHAQKVQPPVE

SEQ ID NO: 13930 - protein, 15 aa, Homo Sapiens
VDEFLSFVPAPDGKG

SEQ ID NO: 13931 - protein, 15 aa, Homo Sapiens
FLSFVPAPDGKGFRM

SEQ ID NO: 13932 - protein, 15 aa, Homo Sapiens
GKGFRMLLASPGACF

SEQ ID NO: 13933 - protein, 15 aa, Homo Sapiens
YNKFVQSCIDWNREV

SEQ ID NO: 13934 - protein, 15 aa, Homo Sapiens
CIDWNREVLKRELGL

SEQ ID NO: 13935 - protein, 15 aa, Homo Sapiens
FTPYHMLHGEVHCGT

SEQ ID NO: 13936 - protein, 15 aa, Homo Sapiens
MSVMVLRTQGPAALF

SEQ ID NO: 13937 - protein, 15 aa, Homo Sapiens
CCCLEEKVRSLLEPL

SEQ ID NO: 13938 - protein, 15 aa, Homo Sapiens
LQRIVRVSLEHPTSA

SEQ ID NO: 13939 - protein, 15 aa, Homo Sapiens
QRIVRVSLEHPTSAV

SEQ ID NO: 13940 - protein, 15 aa, Homo Sapiens
RVSLEHPTSAVCVAG

SEQ ID NO: 13941 - protein, 15 aa, Homo Sapiens
VAGVETLVDIYGSVP

SEQ ID NO: 13942 - protein, 15 aa, Homo Sapiens
VETLVDIYGSVPEGT

SEQ ID NO: 13943 - protein, 15 aa, Homo Sapiens
ETLVDIYGSVPEGTE

SEQ ID NO: 13944 - protein, 15 aa, Homo Sapiens
LVDIYGSVPEGTEMF

SEQ ID NO: 13945 - protein, 15 aa, Homo Sapiens
GTEMFEVYGTPGVDI

SEQ ID NO: 13946 - protein, 15 aa, Homo Sapiens
MFEVYGTPGVDIYIS

SEQ ID NO: 13947 - protein, 15 aa, Homo Sapiens
GVDIYISPNMERGRE

SEQ ID NO: 13948 - protein, 15 aa, Homo Sapiens
SNDLNDSHVQISYHS

SEQ ID NO: 13949 - protein, 15 aa, Homo Sapiens
DSHVQISYHSSHEPL

SEQ ID NO: 13950 - protein, 15 aa, Homo Sapiens
HVQISYHSSHEPLPL

SEQ ID NO: 13951 - protein, 15 aa, Homo Sapiens
HEPLPLAYAVLYLTC

SEQ ID NO: 13952 - protein, 15 aa, Homo Sapiens
YAVLYLTCVDISLDC

SEQ ID NO: 13953 - protein, 15 aa, Homo Sapiens
VLYLTCVDISLDCDL

SEQ ID NO: 13954 - protein, 15 aa, Homo Sapiens
LTCVDISLDCDLNCE

SEQ ID NO: 13955 - protein, 15 aa, Homo Sapiens
CVDISLDCDLNCEGR

SEQ ID NO: 13956 - protein, 15 aa, Homo Sapiens
YGGILLVNCDRDDPS

SEQ ID NO: 13957 - protein, 15 aa, Homo Sapiens
GILLVNCDRDDPSCD

SEQ ID NO: 13958 - protein, 15 aa, Homo Sapiens
SCDVQDNCDQHVHCL

SEQ ID NO: 13959 - protein, 15 aa, Homo Sapiens
DQHVHCLQDLEDMSV

SEQ ID NO: 13960 - protein, 15 aa, Homo Sapiens
LQDLEDMSVMVLRTQ

SEQ ID NO: 13961 - protein, 15 aa, Homo Sapiens
LEDMSVMVLRTQGPA

SEQ ID NO: 13962 - protein, 15 aa, Homo Sapiens
SVMVLRTQGPAALFD

SEQ ID NO: 13963 - protein, 15 aa, Homo Sapiens
VMVLRTQGPAALFDD

SEQ ID NO: 13964 - protein, 15 aa, Homo Sapiens
DHKLVLHTSSYDAKR

SEQ ID NO: 13965 - protein, 15 aa, Homo Sapiens
KLVLHTSSYDAKRAQ

SEQ ID NO: 13966 - protein, 15 aa, Homo Sapiens
RAQVFHICGPEDVCE

SEQ ID NO: 13967 - protein, 15 aa, Homo Sapiens
RHVLGQDKVSYEVPR

SEQ ID NO: 13968 - protein, 15 aa, Homo Sapiens
QDKVSYEVPRLHGDE

SEQ ID NO: 13969 - protein, 15 aa, Homo Sapiens
SYEVPRLHGDEERFF

SEQ ID NO: 13970 - protein, 15 aa, Homo Sapiens
VPRLHGDEERFFVEG

SEQ ID NO: 13971 - protein, 15 aa, Homo Sapiens
VEGLSFPDAGFTGLI

SEQ ID NO: 13972 - protein, 15 aa, Homo Sapiens
TGLISFHVTLLDDSN

SEQ ID NO: 13973 - protein, 15 aa, Homo Sapiens
SFHVTLLDDSNEDFS

SEQ ID NO: 13974 - protein, 15 aa, Homo Sapiens
VTLLDDSNEDFSASP

SEQ ID NO: 13975 - protein, 15 aa, Homo Sapiens
ASPIFTDTVVFRVAP

SEQ ID NO: 13976 - protein, 15 aa, Homo Sapiens
VFRVAPWIMTPSTLP

SEQ ID NO: 13977 - protein, 15 aa, Homo Sapiens
APWIMTPSTLPPLEV

SEQ ID NO: 13978 - protein, 15 aa, Homo Sapiens
PWIMTPSTLPPLEVY

SEQ ID NO: 13979 - protein, 15 aa, Homo Sapiens
PSTLPPLEVYVCRVR

SEQ ID NO: 13980 - protein, 15 aa, Homo Sapiens
PLEVYVCRVRNNTCF

SEQ ID NO: 13981 - protein, 15 aa, Homo Sapiens
TCFVDAVAELARKAG

SEQ ID NO: 13982 - protein, 15 aa, Homo Sapiens
KLTICPQAENRNDRW

SEQ ID NO: 13983 - protein, 15 aa, Homo Sapiens
DRWIQDEMELGYVQA

SEQ ID NO: 13984 - protein, 15 aa, Homo Sapiens
HKTLPVVFDSPRNGE

SEQ ID NO: 13985 - protein, 15 aa, Homo Sapiens
TLPVVFDSPRNGELQ

SEQ ID NO: 13986 - protein, 15 aa, Homo Sapiens
LPVVFDSPRNGELQD

SEQ ID NO: 13987 - protein, 15 aa, Homo Sapiens
YKRILGPDFGYVTRE

SEQ ID NO: 13988 - protein, 15 aa, Homo Sapiens
FGNLEVSPPVVANGK

SEQ ID NO: 13989 - protein, 15 aa, Homo Sapiens
PPVVANGKEYPLGRI

SEQ ID NO: 13990 - protein, 15 aa, Homo Sapiens
LGRILIGGNLPGSSG

SEQ ID NO: 13991 - protein, 15 aa, Homo Sapiens
GRILIGGNLPGSSGR

SEQ ID NO: 13992 - protein, 15 aa, Homo Sapiens
RILIGGNLPGSSGRR

SEQ ID NO: 13993 - protein, 15 aa, Homo Sapiens
GGNLPGSSGRRVTQV

SEQ ID NO: 13994 - protein, 15 aa, Homo Sapiens
AQKVQPPVELFVDWL

SEQ ID NO: 13995 - protein, 15 aa, Homo Sapiens
PVELFVDWLAVGHVD

SEQ ID NO: 13996 - protein, 15 aa, Homo Sapiens
DEFLSFVPAPDGKGF

SEQ ID NO: 13997 - protein, 15 aa, Homo Sapiens
GFRMLLASPGACFKL

SEQ ID NO: 13998 - protein, 15 aa, Homo Sapiens
RMLLASPGACFKLFQ

SEQ ID NO: 13999 - protein, 15 aa, Homo Sapiens
VKTISINQVLSNKDL

SEQ ID NO: 14000 - protein, 15 aa, Homo Sapiens
INQVLSNKDLINYNK

SEQ ID NO: 14001 - protein, 15 aa, Homo Sapiens
NKDLINYNKFVQSCI

SEQ ID NO: 14002 - protein, 15 aa, Homo Sapiens
KDLINYNKFVQSCID

SEQ ID NO: 14003 - protein, 15 aa, Homo Sapiens
QSCIDWNREVLKREL

SEQ ID NO: 14004 - protein, 15 aa, Homo Sapiens
REVLKRELGLAECDI

SEQ ID NO: 14005 - protein, 15 aa, Homo Sapiens
ELGLAECDIIDIPQL

SEQ ID NO: 14006 - protein, 15 aa, Homo Sapiens
CDIIDIPQLFKTERK

SEQ ID NO: 14007 - protein, 15 aa, Homo Sapiens
IIDIPQLFKTERKKA

SEQ ID NO: 14008 - protein, 15 aa, Homo Sapiens
FPDLVNMLVLGKHLG

SEQ ID NO: 14009 - protein, 15 aa, Homo Sapiens
PDLVNMLVLGKHLGI

SEQ ID NO: 14010 - protein, 15 aa, Homo Sapiens
LVNMLVLGKHLGIPK

SEQ ID NO: 14011 - protein, 15 aa, Homo Sapiens
MLVLGKHLGIPKPFG

SEQ ID NO: 14012 - protein, 15 aa, Homo Sapiens
HLGIPKPFGPIINGC

SEQ ID NO: 14013 - protein, 15 aa, Homo Sapiens
EEKVRSLLEPLGLHC

SEQ ID NO: 14014 - protein, 15 aa, Homo Sapiens
LEPLGLHCTFIDDFT

SEQ ID NO: 14015 - protein, 15 aa, Homo Sapiens
HGEVHCGTNVCRKPF

SEQ ID NO: 14016 - protein, 15 aa, Homo Sapiens
VRVSLEHPTSAVCVA

SEQ ID NO: 14017 - protein, 15 aa, Homo Sapiens
EHPTSAVCVAGVETL

SEQ ID NO: 14018 - protein, 15 aa, Homo Sapiens
PTSAVCVAGVETLVD

SEQ ID NO: 14019 - protein, 15 aa, Homo Sapiens
VCVAGVETLVDIYGS

SEQ ID NO: 14020 - protein, 15 aa, Homo Sapiens
AGVETLVDIYGSVPE

SEQ ID NO: 14021 - protein, 15 aa, Homo Sapiens
GVETLVDIYGSVPEG

SEQ ID NO: 14022 - protein, 15 aa, Homo Sapiens
IYGSVPEGTEMFEVY

SEQ ID NO: 14023 - protein, 15 aa, Homo Sapiens
PEGTEMFEVYGTPGV

SEQ ID NO: 14024 - protein, 15 aa, Homo Sapiens
VYGTPGVDIYISPNM

SEQ ID NO: 14025 - protein, 15 aa, Homo Sapiens
GTPGVDIYISPNMER

SEQ ID NO: 14026 - protein, 15 aa, Homo Sapiens
ERGRERADTRRWRFD

SEQ ID NO: 14027 - protein, 15 aa, Homo Sapiens
RGRERADTRRWRFDA

SEQ ID NO: 14028 - protein, 15 aa, Homo Sapiens
RRWRFDATLEIIVVM

SEQ ID NO: 14029 - protein, 15 aa, Homo Sapiens
WRFDATLEIIVVMNS

SEQ ID NO: 14030 - protein, 15 aa, Homo Sapiens
RFDATLEIIVVMNSP

SEQ ID NO: 14031 - protein, 15 aa, Homo Sapiens
FDATLEIIVVMNSPS

SEQ ID NO: 14032 - protein, 15 aa, Homo Sapiens
MNSPSNDLNDSHVQI

SEQ ID NO: 14033 - protein, 15 aa, Homo Sapiens
NSPSNDLNDSHVQIS

SEQ ID NO: 14034 - protein, 15 aa, Homo Sapiens
SPSNDLNDSHVQISY

SEQ ID NO: 14035 - protein, 15 aa, Homo Sapiens
LNDSHVQISYHSSHE

SEQ ID NO: 14036 - protein, 15 aa, Homo Sapiens
NDSHVQISYHSSHEP

SEQ ID NO: 14037 - protein, 15 aa, Homo Sapiens
VQISYHSSHEPLPLA

SEQ ID NO: 14038 - protein, 15 aa, Homo Sapiens
SYHSSHEPLPLAYAV

SEQ ID NO: 14039 - protein, 15 aa, Homo Sapiens
HSSHEPLPLAYAVLY

SEQ ID NO: 14040 - protein, 15 aa, Homo Sapiens
SHEPLPLAYAVLYLT

SEQ ID NO: 14041 - protein, 15 aa, Homo Sapiens
LYLTCVDISLDCDLN

SEQ ID NO: 14042 - protein, 15 aa, Homo Sapiens
TCVDISLDCDLNCEG

SEQ ID NO: 14043 - protein, 15 aa, Homo Sapiens
CDLNCEGRQDRNFVD

SEQ ID NO: 14044 - protein, 15 aa, Homo Sapiens
LNCEGRQDRNFVDKR

SEQ ID NO: 14045 - protein, 15 aa, Homo Sapiens
NCEGRQDRNFVDKRQ

SEQ ID NO: 14046 - protein, 15 aa, Homo Sapiens
GRQDRNFVDKRQWVW

SEQ ID NO: 14047 - protein, 15 aa, Homo Sapiens
GYGGILLVNCDRDDP

SEQ ID NO: 14048 - protein, 15 aa, Homo Sapiens
RDDPSCDVQDNCDQH

SEQ ID NO: 14049 - protein, 15 aa, Homo Sapiens
DPSCDVQDNCDQHVH

SEQ ID NO: 14050 - protein, 15 aa, Homo Sapiens
DVQDNCDQHVHCLQD

SEQ ID NO: 14051 - protein, 15 aa, Homo Sapiens
QDNCDQHVHCLQDLE

SEQ ID NO: 14052 - protein, 15 aa, Homo Sapiens
HVHCLQDLEDMSVMV

SEQ ID NO: 14053 - protein, 15 aa, Homo Sapiens
HCLQDLEDMSVMVLR

SEQ ID NO: 14054 - protein, 15 aa, Homo Sapiens
DLEDMSVMVLRTQGP

SEQ ID NO: 14055 - protein, 15 aa, Homo Sapiens
EDMSVMVLRTQGPAA

SEQ ID NO: 14056 - protein, 15 aa, Homo Sapiens
TQGPAALFDDHKLVL

SEQ ID NO: 14057 - protein, 15 aa, Homo Sapiens
QGPAALFDDHKLVLH

SEQ ID NO: 14058 - protein, 15 aa, Homo Sapiens
LFDDHKLVLHTSSYD

SEQ ID NO: 14059 - protein, 15 aa, Homo Sapiens
DDHKLVLHTSSYDAK

SEQ ID NO: 14060 - protein, 15 aa, Homo Sapiens
LHTSSYDAKRAQVFH

SEQ ID NO: 14061 - protein, 15 aa, Homo Sapiens
SYDAKRAQVFHICGP

SEQ ID NO: 14062 - protein, 15 aa, Homo Sapiens
DAKRAQVFHICGPED

SEQ ID NO: 14063 - protein, 15 aa, Homo Sapiens
FHICGPEDVCEAYRH

SEQ ID NO: 14064 - protein, 15 aa, Homo Sapiens
GPEDVCEAYRHVLGQ

SEQ ID NO: 14065 - protein, 15 aa, Homo Sapiens
DKVSYEVPRLHGDEE

SEQ ID NO: 14066 - protein, 15 aa, Homo Sapiens
HGDEERFFVEGLSFP

SEQ ID NO: 14067 - protein, 15 aa, Homo Sapiens
GDEERFFVEGLSFPD

SEQ ID NO: 14068 - protein, 15 aa, Homo Sapiens
LSFPDAGFTGLISFH

SEQ ID NO: 14069 - protein, 15 aa, Homo Sapiens
SFPDAGFTGLISFHV

SEQ ID NO: 14070 - protein, 15 aa, Homo Sapiens
AGFTGLISFHVTLLD

SEQ ID NO: 14071 - protein, 15 aa, Homo Sapiens
GFTGLISFHVTLLDD

SEQ ID NO: 14072 - protein, 15 aa, Homo Sapiens
ISFHVTLLDDSNEDF

SEQ ID NO: 14073 - protein, 15 aa, Homo Sapiens
FHVTLLDDSNEDFSA

SEQ ID NO: 14074 - protein, 15 aa, Homo Sapiens
LLDDSNEDFSASPIF

SEQ ID NO: 14075 - protein, 15 aa, Homo Sapiens
LDDSNEDFSASPIFT

SEQ ID NO: 14076 - protein, 15 aa, Homo Sapiens
DDSNEDFSASPIFTD

SEQ ID NO: 14077 - protein, 15 aa, Homo Sapiens
SNEDFSASPIFTDTV

SEQ ID NO: 14078 - protein, 15 aa, Homo Sapiens
FSASPIFTDTVVFRV

SEQ ID NO: 14079 - protein, 15 aa, Homo Sapiens
PIFTDTVVFRVAPWI

SEQ ID NO: 14080 - protein, 15 aa, Homo Sapiens
IFTDTVVFRVAPWIM

SEQ ID NO: 14081 - protein, 15 aa, Homo Sapiens
IMTPSTLPPLEVYVC

SEQ ID NO: 14082 - protein, 15 aa, Homo Sapiens
TLPPLEVYVCRVRNN

SEQ ID NO: 14083 - protein, 15 aa, Homo Sapiens
YVCRVRNNTCFVDAV

SEQ ID NO: 14084 - protein, 15 aa, Homo Sapiens
VRNNTCFVDAVAELA

SEQ ID NO: 14085 - protein, 15 aa, Homo Sapiens
NNTCFVDAVAELARK

SEQ ID NO: 14086 - protein, 15 aa, Homo Sapiens
CFVDAVAELARKAGC

SEQ ID NO: 14087 - protein, 15 aa, Homo Sapiens
FVDAVAELARKAGCK

SEQ ID NO: 14088 - protein, 15 aa, Homo Sapiens
AELARKAGCKLTICP

SEQ ID NO: 14089 - protein, 15 aa, Homo Sapiens
RKAGCKLTICPQAEN

SEQ ID NO: 14090 - protein, 15 aa, Homo Sapiens
LTICPQAENRNDRWI

SEQ ID NO: 14091 - protein, 15 aa, Homo Sapiens
TICPQAENRNDRWIQ

SEQ ID NO: 14092 - protein, 15 aa, Homo Sapiens
PQAENRNDRWIQDEM

SEQ ID NO: 14093 - protein, 15 aa, Homo Sapiens
ENRNDRWIQDEMELG

SEQ ID NO: 14094 - protein, 15 aa, Homo Sapiens
WIQDEMELGYVQAPH

SEQ ID NO: 14095 - protein, 15 aa, Homo Sapiens
IQDEMELGYVQAPHK

SEQ ID NO: 14096 - protein, 15 aa, Homo Sapiens
GYVQAPHKTLPVVFD

SEQ ID NO: 14097 - protein, 15 aa, Homo Sapiens
DSPRNGELQDFPYKR

SEQ ID NO: 14098 - protein, 15 aa, Homo Sapiens
VTREPRDRSVSGLDS

SEQ ID NO: 14099 - protein, 15 aa, Homo Sapiens
EPRDRSVSGLDSFGN

SEQ ID NO: 14100 - protein, 15 aa, Homo Sapiens
RSVSGLDSFGNLEVS

SEQ ID NO: 14101 - protein, 15 aa, Homo Sapiens
SFGNLEVSPPVVANG

SEQ ID NO: 14102 - protein, 15 aa, Homo Sapiens
LEVSPPVVANGKEYP

SEQ ID NO: 14103 - protein, 15 aa, Homo Sapiens
EVSPPVVANGKEYPL

SEQ ID NO: 14104 - protein, 15 aa, Homo Sapiens
YPLGRILIGGNLPGS

SEQ ID NO: 14105 - protein, 15 aa, Homo Sapiens
GNLPGSSGRRVTQVV

SEQ ID NO: 14106 - protein, 15 aa, Homo Sapiens
NLPGSSGRRVTQVVR

SEQ ID NO: 14107 - protein, 15 aa, Homo Sapiens
GSSGRRVTQVVRDFL

SEQ ID NO: 14108 - protein, 15 aa, Homo Sapiens
QVVRDFLHAQKVQPP

SEQ ID NO: 14109 - protein, 15 aa, Homo Sapiens
VVRDFLHAQKVQPPV

SEQ ID NO: 14110 - protein, 15 aa, Homo Sapiens
VQPPVELFVDWLAVG

SEQ ID NO: 14111 - protein, 15 aa, Homo Sapiens
PPVELFVDWLAVGHV

SEQ ID NO: 14112 - protein, 15 aa, Homo Sapiens
AVGHVDEFLSFVPAP

SEQ ID NO: 14113 - protein, 15 aa, Homo Sapiens
GHVDEFLSFVPAPDG

SEQ ID NO: 14114 - protein, 15 aa, Homo Sapiens
PAPDGKGFRMLLASP

SEQ ID NO: 14115 - protein, 15 aa, Homo Sapiens
APDGKGFRMLLASPG

SEQ ID NO: 14116 - protein, 15 aa, Homo Sapiens
FQEKQKCGHGRALLF

SEQ ID NO: 14117 - protein, 15 aa, Homo Sapiens
EKQKCGHGRALLFQG

SEQ ID NO: 14118 - protein, 15 aa, Homo Sapiens
CGHGRALLFQGVVDD

SEQ ID NO: 14119 - protein, 15 aa, Homo Sapiens
LLFQGVVDDEQVKTI

SEQ ID NO: 14120 - protein, 15 aa, Homo Sapiens
LFQGVVDDEQVKTIS

SEQ ID NO: 14121 - protein, 15 aa, Homo Sapiens
DDEQVKTISINQVLS

SEQ ID NO: 14122 - protein, 15 aa, Homo Sapiens
EQVKTISINQVLSNK

SEQ ID NO: 14123 - protein, 15 aa, Homo Sapiens
QVLSNKDLINYNKFV

SEQ ID NO: 14124 - protein, 15 aa, Homo Sapiens
SNKDLINYNKFVQSC

SEQ ID NO: 14125 - protein, 15 aa, Homo Sapiens
INYNKFVQSCIDWNR

SEQ ID NO: 14126 - protein, 15 aa, Homo Sapiens
VQSCIDWNREVLKRE

SEQ ID NO: 14127 - protein, 15 aa, Homo Sapiens
IDWNREVLKRELGLA

SEQ ID NO: 14128 - protein, 15 aa, Homo Sapiens
DWNREVLKRELGLAE

SEQ ID NO: 14129 - protein, 15 aa, Homo Sapiens
LKRELGLAECDIIDI

SEQ ID NO: 14130 - protein, 15 aa, Homo Sapiens
GLAECDIIDIPQLFK

SEQ ID NO: 14131 - protein, 15 aa, Homo Sapiens
LAECDIIDIPQLFKT

SEQ ID NO: 14132 - protein, 15 aa, Homo Sapiens
ERKKATAFFPDLVNM

SEQ ID NO: 14133 - protein, 15 aa, Homo Sapiens
RKKATAFFPDLVNML

SEQ ID NO: 14134 - protein, 15 aa, Homo Sapiens
KKATAFFPDLVNMLV

SEQ ID NO: 14135 - protein, 15 aa, Homo Sapiens
AFFPDLVNMLVLGKH

SEQ ID NO: 14136 - protein, 15 aa, Homo Sapiens
DLVNMLVLGKHLGIP

SEQ ID NO: 14137 - protein, 15 aa, Homo Sapiens
LGIPKPFGPIINGCC

SEQ ID NO: 14138 - protein, 15 aa, Homo Sapiens
NGCCCLEEKVRSLLE

SEQ ID NO: 14139 - protein, 15 aa, Homo Sapiens
GCCCLEEKVRSLLEP

SEQ ID NO: 14140 - protein, 15 aa, Homo Sapiens
CCLEEKVRSLLEPLG

SEQ ID NO: 14141 - protein, 15 aa, Homo Sapiens
EKVRSLLEPLGLHCT

SEQ ID NO: 14142 - protein, 15 aa, Homo Sapiens
LLEPLGLHCTFIDDF

SEQ ID NO: 14143 - protein, 15 aa, Homo Sapiens
LGLHCTFIDDFTPYH

SEQ ID NO: 14144 - protein, 15 aa, Homo Sapiens
DFTPYHMLHGEVHCG

SEQ ID NO: 14145 - protein, 15 aa, Homo Sapiens
HMLHGEVHCGTNVCR

SEQ ID NO: 14146 - protein, 15 aa, Homo Sapiens
VHCGTNVCRKPFSFK

SEQ ID NO: 14147 - protein, 15 aa, Homo Sapiens
DRNFVDKRQWVWGPS

SEQ ID NO: 14148 - protein, 15 aa, Homo Sapiens
FEVYGTPGVDIYISP

SEQ ID NO: 14149 - protein, 15 aa, Homo Sapiens
VDIYISPNMERGRER

SEQ ID NO: 14150 - protein, 15 aa, Homo Sapiens
QISYHSSHEPLPLAY

SEQ ID NO: 14151 - protein, 15 aa, Homo Sapiens
AALFDDHKLVLHTSS

SEQ ID NO: 14152 - protein, 15 aa, Homo Sapiens
KVSYEVPRLHGDEER

SEQ ID NO: 14153 - protein, 15 aa, Homo Sapiens
NEDFSASPIFTDTVV

SEQ ID NO: 14154 - protein, 15 aa, Homo Sapiens
GKEYPLGRILIGGNL

SEQ ID NO: 14155 - protein, 15 aa, Homo Sapiens
VELFVDWLAVGHVDE

SEQ ID NO: 14156 - protein, 15 aa, Homo Sapiens
IDDFTPYHMLHGEVH

SEQ ID NO: 14157 - protein, 15 aa, Homo Sapiens
TDTVVFRVAPWIMTP

SEQ ID NO: 14158 - protein, 15 aa, Homo Sapiens
VAELARKAGCKLTIC

SEQ ID NO: 14159 - protein, 15 aa, Homo Sapiens
NREVLKRELGLAECD

SEQ ID NO: 14160 - protein, 15 aa, Homo Sapiens
GTNVCRKPFSFKWWN

SEQ ID NO: 14161 - protein, 15 aa, Homo Sapiens
YGSVPEGTEMFEVYG

SEQ ID NO: 14162 - protein, 15 aa, Homo Sapiens
DIYISPNMERGRERA

SEQ ID NO: 14163 - protein, 15 aa, Homo Sapiens
SPNMERGRERADTRR

SEQ ID NO: 14164 - protein, 15 aa, Homo Sapiens
EIIVVMNSPSNDLND

SEQ ID NO: 14165 - protein, 15 aa, Homo Sapiens
RQWVWGPSGYGGILL

SEQ ID NO: 14166 - protein, 15 aa, Homo Sapiens
GGILLVNCDRDDPSC

SEQ ID NO: 14167 - protein, 15 aa, Homo Sapiens
VFHICGPEDVCEAYR

SEQ ID NO: 14168 - protein, 15 aa, Homo Sapiens
YRHVLGQDKVSYEVP

SEQ ID NO: 14169 - protein, 15 aa, Homo Sapiens
LPPLEVYVCRVRNNT

SEQ ID NO: 14170 - protein, 15 aa, Homo Sapiens
VCRVRNNTCFVDAVA

SEQ ID NO: 14171 - protein, 15 aa, Homo Sapiens
QDEMELGYVQAPHKT

SEQ ID NO: 14172 - protein, 15 aa, Homo Sapiens
LGYVQAPHKTLPVVF

SEQ ID NO: 14173 - protein, 15 aa, Homo Sapiens
NLEVSPPVVANGKEY

SEQ ID NO: 14174 - protein, 15 aa, Homo Sapiens
SPPVVANGKEYPLGR

SEQ ID NO: 14175 - protein, 15 aa, Homo Sapiens
RDFLHAQKVQPPVEL

SEQ ID NO: 14176 - protein, 15 aa, Homo Sapiens
VDWLAVGHVDEFLSF

SEQ ID NO: 14177 - protein, 15 aa, Homo Sapiens
LSFVPAPDGKGFRML

SEQ ID NO: 14178 - protein, 15 aa, Homo Sapiens
FRMLLASPGACFKLF

SEQ ID NO: 14179 - protein, 15 aa, Homo Sapiens
GRALLFQGVVDDEQV

SEQ ID NO: 14180 - protein, 15 aa, Homo Sapiens
RALLFQGVVDDEQVK

SEQ ID NO: 14181 - protein, 15 aa, Homo Sapiens
NKFVQSCIDWNREVL

SEQ ID NO: 14182 - protein, 15 aa, Homo Sapiens
GKHLGIPKPFGPIIN

SEQ ID NO: 14183 - protein, 15 aa, Homo Sapiens
FGPIINGCCCLEEKV

SEQ ID NO: 14184 - protein, 15 aa, Homo Sapiens
GPIINGCCCLEEKVR

SEQ ID NO: 14185 - protein, 15 aa, Homo Sapiens
VRSLLEPLGLHCTFI

SEQ ID NO: 14186 - protein, 15 aa, Homo Sapiens
PLGLHCTFIDDFTPY

SEQ ID NO: 14187 - protein, 15 aa, Homo Sapiens
PYHMLHGEVHCGTNV

SEQ ID NO: 14188 - protein, 15 aa, Homo Sapiens
ISPNMERGRERADTR

SEQ ID NO: 14189 - protein, 15 aa, Homo Sapiens
PNMERGRERADTRRW

SEQ ID NO: 14190 - protein, 15 aa, Homo Sapiens
ERADTRRWRFDATLE

SEQ ID NO: 14191 - protein, 15 aa, Homo Sapiens
HVLGQDKVSYEVPRL

SEQ ID NO: 14192 - protein, 15 aa, Homo Sapiens
YVTREPRDRSVSGLD

SEQ ID NO: 14193 - protein, 15 aa, Homo Sapiens
PGSSGRRVTQVVRDF

SEQ ID NO: 14194 - protein, 15 aa, Homo Sapiens
DFLHAQKVQPPVELF

SEQ ID NO: 14195 - protein, 15 aa, Homo Sapiens
MSLQRIVRVSLEHPT

SEQ ID NO: 14196 - protein, 15 aa, Homo Sapiens
VSLEHPTSAVCVAGV

SEQ ID NO: 14197 - protein, 15 aa, Homo Sapiens
SLEHPTSAVCVAGVE

SEQ ID NO: 14198 - protein, 15 aa, Homo Sapiens
LEHPTSAVCVAGVET

SEQ ID NO: 14199 - protein, 15 aa, Homo Sapiens
SAVCVAGVETLVDIY

SEQ ID NO: 14200 - protein, 15 aa, Homo Sapiens
DIYGSVPEGTEMFEV

SEQ ID NO: 14201 - protein, 15 aa, Homo Sapiens
GSVPEGTEMFEVYGT

SEQ ID NO: 14202 - protein, 15 aa, Homo Sapiens
SVPEGTEMFEVYGTP

SEQ ID NO: 14203 - protein, 15 aa, Homo Sapiens
EGTEMFEVYGTPGVD

SEQ ID NO: 14204 - protein, 15 aa, Homo Sapiens
EVYGTPGVDIYISPN

SEQ ID NO: 14205 - protein, 15 aa, Homo Sapiens
YGTPGVDIYISPNME

SEQ ID NO: 14206 - protein, 15 aa, Homo Sapiens
PGVDIYISPNMERGR

SEQ ID NO: 14207 - protein, 15 aa, Homo Sapiens
IYISPNMERGRERAD

SEQ ID NO: 14208 - protein, 15 aa, Homo Sapiens
YISPNMERGRERADT

SEQ ID NO: 14209 - protein, 15 aa, Homo Sapiens
NMERGRERADTRRWR

SEQ ID NO: 14210 - protein, 15 aa, Homo Sapiens
GRERADTRRWRFDAT

SEQ ID NO: 14211 - protein, 15 aa, Homo Sapiens
RADTRRWRFDATLEI

SEQ ID NO: 14212 - protein, 15 aa, Homo Sapiens
DTRRWRFDATLEIIV

SEQ ID NO: 14213 - protein, 15 aa, Homo Sapiens
ATLEIIVVMNSPSND

SEQ ID NO: 14214 - protein, 15 aa, Homo Sapiens
VMNSPSNDLNDSHVQ

SEQ ID NO: 14215 - protein, 15 aa, Homo Sapiens
NDLNDSHVQISYHSS

SEQ ID NO: 14216 - protein, 15 aa, Homo Sapiens
DLNDSHVQISYHSSH

SEQ ID NO: 14217 - protein, 15 aa, Homo Sapiens
SHVQISYHSSHEPLP

SEQ ID NO: 14218 - protein, 15 aa, Homo Sapiens
ISYHSSHEPLPLAYA

SEQ ID NO: 14219 - protein, 15 aa, Homo Sapiens
SSHEPLPLAYAVLYL

SEQ ID NO: 14220 - protein, 15 aa, Homo Sapiens
EPLPLAYAVLYLTCV

SEQ ID NO: 14221 - protein, 15 aa, Homo Sapiens
LPLAYAVLYLTCVDI

SEQ ID NO: 14222 - protein, 15 aa, Homo Sapiens
LAYAVLYLTCVDISL

SEQ ID NO: 14223 - protein, 15 aa, Homo Sapiens
YLTCVDISLDCDLNC

SEQ ID NO: 14224 - protein, 15 aa, Homo Sapiens
ISLDCDLNCEGRQDR

SEQ ID NO: 14225 - protein, 15 aa, Homo Sapiens
SLDCDLNCEGRQDRN

SEQ ID NO: 14226 - protein, 15 aa, Homo Sapiens
RQDRNFVDKRQWVWG

SEQ ID NO: 14227 - protein, 15 aa, Homo Sapiens
FVDKRQWVWGPSGYG

SEQ ID NO: 14228 - protein, 15 aa, Homo Sapiens
VDKRQWVWGPSGYGG

SEQ ID NO: 14229 - protein, 15 aa, Homo Sapiens
WVWGPSGYGGILLVN

SEQ ID NO: 14230 - protein, 15 aa, Homo Sapiens
VWGPSGYGGILLVNC

SEQ ID NO: 14231 - protein, 15 aa, Homo Sapiens
WGPSGYGGILLVNCD

SEQ ID NO: 14232 - protein, 15 aa, Homo Sapiens
GPSGYGGILLVNCDR

SEQ ID NO: 14233 - protein, 15 aa, Homo Sapiens
SGYGGILLVNCDRDD

SEQ ID NO: 14234 - protein, 15 aa, Homo Sapiens
LVNCDRDDPSCDVQD

SEQ ID NO: 14235 - protein, 15 aa, Homo Sapiens
NCDRDDPSCDVQDNC

SEQ ID NO: 14236 - protein, 15 aa, Homo Sapiens
DRDDPSCDVQDNCDQ

SEQ ID NO: 14237 - protein, 15 aa, Homo Sapiens
DDPSCDVQDNCDQHV

SEQ ID NO: 14238 - protein, 15 aa, Homo Sapiens
PSCDVQDNCDQHVHC

SEQ ID NO: 14239 - protein, 15 aa, Homo Sapiens
CDVQDNCDQHVHCLQ

SEQ ID NO: 14240 - protein, 15 aa, Homo Sapiens
VQDNCDQHVHCLQDL

SEQ ID NO: 14241 - protein, 15 aa, Homo Sapiens
DNCDQHVHCLQDLED

SEQ ID NO: 14242 - protein, 15 aa, Homo Sapiens
NCDQHVHCLQDLEDM

SEQ ID NO: 14243 - protein, 15 aa, Homo Sapiens
CDQHVHCLQDLEDMS

SEQ ID NO: 14244 - protein, 15 aa, Homo Sapiens
QHVHCLQDLEDMSVM

SEQ ID NO: 14245 - protein, 15 aa, Homo Sapiens
LRTQGPAALFDDHKL

SEQ ID NO: 14246 - protein, 15 aa, Homo Sapiens
RTQGPAALFDDHKLV

SEQ ID NO: 14247 - protein, 15 aa, Homo Sapiens
VLHTSSYDAKRAQVF

SEQ ID NO: 14248 - protein, 15 aa, Homo Sapiens
AKRAQVFHICGPEDV

SEQ ID NO: 14249 - protein, 15 aa, Homo Sapiens
HICGPEDVCEAYRHV

SEQ ID NO: 14250 - protein, 15 aa, Homo Sapiens
ICGPEDVCEAYRHVL

SEQ ID NO: 14251 - protein, 15 aa, Homo Sapiens
EDVCEAYRHVLGQDK

SEQ ID NO: 14252 - protein, 15 aa, Homo Sapiens
AYRHVLGQDKVSYEV

SEQ ID NO: 14253 - protein, 15 aa, Homo Sapiens
VLGQDKVSYEVPRLH

SEQ ID NO: 14254 - protein, 15 aa, Homo Sapiens
GQDKVSYEVPRLHGD

SEQ ID NO: 14255 - protein, 15 aa, Homo Sapiens
RLHGDEERFFVEGLS

SEQ ID NO: 14256 - protein, 15 aa, Homo Sapiens
DEERFFVEGLSFPDA

SEQ ID NO: 14257 - protein, 15 aa, Homo Sapiens
FVEGLSFPDAGFTGL

SEQ ID NO: 14258 - protein, 15 aa, Homo Sapiens
EGLSFPDAGFTGLIS

SEQ ID NO: 14259 - protein, 15 aa, Homo Sapiens
GLISFHVTLLDDSNE

SEQ ID NO: 14260 - protein, 15 aa, Homo Sapiens
TLLDDSNEDFSASPI

SEQ ID NO: 14261 - protein, 15 aa, Homo Sapiens
DSNEDFSASPIFTDT

SEQ ID NO: 14262 - protein, 15 aa, Homo Sapiens
EDFSASPIFTDTVVF

SEQ ID NO: 14263 - protein, 15 aa, Homo Sapiens
SASPIFTDTVVFRVA

SEQ ID NO: 14264 - protein, 15 aa, Homo Sapiens
FTDTVVFRVAPWIMT

SEQ ID NO: 14265 - protein, 15 aa, Homo Sapiens
RVAPWIMTPSTLPPL

SEQ ID NO: 14266 - protein, 15 aa, Homo Sapiens
TPSTLPPLEVYVCRV

SEQ ID NO: 14267 - protein, 15 aa, Homo Sapiens
STLPPLEVYVCRVRN

SEQ ID NO: 14268 - protein, 15 aa, Homo Sapiens
CRVRNNTCFVDAVAE

SEQ ID NO: 14269 - protein, 15 aa, Homo Sapiens
RVRNNTCFVDAVAEL

SEQ ID NO: 14270 - protein, 15 aa, Homo Sapiens
RNNTCFVDAVAELAR

SEQ ID NO: 14271 - protein, 15 aa, Homo Sapiens
DAVAELARKAGCKLT

SEQ ID NO: 14272 - protein, 15 aa, Homo Sapiens
ELARKAGCKLTICPQ

SEQ ID NO: 14273 - protein, 15 aa, Homo Sapiens
KAGCKLTICPQAENR

SEQ ID NO: 14274 - protein, 15 aa, Homo Sapiens
AGCKLTICPQAENRN

SEQ ID NO: 14275 - protein, 15 aa, Homo Sapiens
ICPQAENRNDRWIQD

SEQ ID NO: 14276 - protein, 15 aa, Homo Sapiens
QAENRNDRWIQDEME

SEQ ID NO: 14277 - protein, 15 aa, Homo Sapiens
NRNDRWIQDEMELGY

SEQ ID NO: 14278 - protein, 15 aa, Homo Sapiens
RNDRWIQDEMELGYV

SEQ ID NO: 14279 - protein, 15 aa, Homo Sapiens
RWIQDEMELGYVQAP

SEQ ID NO: 14280 - protein, 15 aa, Homo Sapiens
DEMELGYVQAPHKTL

SEQ ID NO: 14281 - protein, 15 aa, Homo Sapiens
MELGYVQAPHKTLPV

SEQ ID NO: 14282 - protein, 15 aa, Homo Sapiens
QAPHKTLPVVFDSPR

SEQ ID NO: 14283 - protein, 15 aa, Homo Sapiens
APHKTLPVVFDSPRN

SEQ ID NO: 14284 - protein, 15 aa, Homo Sapiens
PHKTLPVVFDSPRNG

SEQ ID NO: 14285 - protein, 15 aa, Homo Sapiens
SPRNGELQDFPYKRI

SEQ ID NO: 14286 - protein, 15 aa, Homo Sapiens
PRNGELQDFPYKRIL

SEQ ID NO: 14287 - protein, 15 aa, Homo Sapiens
RNGELQDFPYKRILG

SEQ ID NO: 14288 - protein, 15 aa, Homo Sapiens
GELQDFPYKRILGPD

SEQ ID NO: 14289 - protein, 15 aa, Homo Sapiens
ELQDFPYKRILGPDF

SEQ ID NO: 14290 - protein, 15 aa, Homo Sapiens
FPYKRILGPDFGYVT

SEQ ID NO: 14291 - protein, 15 aa, Homo Sapiens
RILGPDFGYVTREPR

SEQ ID NO: 14292 - protein, 15 aa, Homo Sapiens
LGPDFGYVTREPRDR

SEQ ID NO: 14293 - protein, 15 aa, Homo Sapiens
GYVTREPRDRSVSGL

SEQ ID NO: 14294 - protein, 15 aa, Homo Sapiens
REPRDRSVSGLDSFG

SEQ ID NO: 14295 - protein, 15 aa, Homo Sapiens
SGLDSFGNLEVSPPV

SEQ ID NO: 14296 - protein, 15 aa, Homo Sapiens
GNLEVSPPVVANGKE

SEQ ID NO: 14297 - protein, 15 aa, Homo Sapiens
VSPPVVANGKEYPLG

SEQ ID NO: 14298 - protein, 15 aa, Homo Sapiens
VVANGKEYPLGRILI

SEQ ID NO: 14299 - protein, 15 aa, Homo Sapiens
VANGKEYPLGRILIG

SEQ ID NO: 14300 - protein, 15 aa, Homo Sapiens
ANGKEYPLGRILIGG

SEQ ID NO: 14301 - protein, 15 aa, Homo Sapiens
PLGRILIGGNLPGSS

SEQ ID NO: 14302 - protein, 15 aa, Homo Sapiens
ILIGGNLPGSSGRRV

SEQ ID NO: 14303 - protein, 15 aa, Homo Sapiens
LIGGNLPGSSGRRVT

SEQ ID NO: 14304 - protein, 15 aa, Homo Sapiens
IGGNLPGSSGRRVTQ

SEQ ID NO: 14305 - protein, 15 aa, Homo Sapiens
RRVTQVVRDFLHAQK

SEQ ID NO: 14306 - protein, 15 aa, Homo Sapiens
FLHAQKVQPPVELFV

SEQ ID NO: 14307 - protein, 15 aa, Homo Sapiens
LHAQKVQPPVELFVD

SEQ ID NO: 14308 - protein, 15 aa, Homo Sapiens
QKVQPPVELFVDWLA

SEQ ID NO: 14309 - protein, 15 aa, Homo Sapiens
KVQPPVELFVDWLAV

SEQ ID NO: 14310 - protein, 15 aa, Homo Sapiens
LFVDWLAVGHVDEFL

SEQ ID NO: 14311 - protein, 15 aa, Homo Sapiens
DWLAVGHVDEFLSFV

SEQ ID NO: 14312 - protein, 15 aa, Homo Sapiens
LAVGHVDEFLSFVPA

SEQ ID NO: 14313 - protein, 15 aa, Homo Sapiens
EFLSFVPAPDGKGFR

SEQ ID NO: 14314 - protein, 15 aa, Homo Sapiens
SFVPAPDGKGFRMLL

SEQ ID NO: 14315 - protein, 15 aa, Homo Sapiens
FVPAPDGKGFRMLLA

SEQ ID NO: 14316 - protein, 15 aa, Homo Sapiens
MLLASPGACFKLFQE

SEQ ID NO: 14317 - protein, 15 aa, Homo Sapiens
LLASPGACFKLFQEK

SEQ ID NO: 14318 - protein, 15 aa, Homo Sapiens
LASPGACFKLFQEKQ

SEQ ID NO: 14319 - protein, 15 aa, Homo Sapiens
ASPGACFKLFQEKQK

SEQ ID NO: 14320 - protein, 15 aa, Homo Sapiens
QEKQKCGHGRALLFQ

SEQ ID NO: 14321 - protein, 15 aa, Homo Sapiens
KCGHGRALLFQGVVD

SEQ ID NO: 14322 - protein, 15 aa, Homo Sapiens
HGRALLFQGVVDDEQ

SEQ ID NO: 14323 - protein, 15 aa, Homo Sapiens
GVVDDEQVKTISINQ

SEQ ID NO: 14324 - protein, 15 aa, Homo Sapiens
KTISINQVLSNKDLI

SEQ ID NO: 14325 - protein, 15 aa, Homo Sapiens
SINQVLSNKDLINYN

SEQ ID NO: 14326 - protein, 15 aa, Homo Sapiens
LSNKDLINYNKFVQS

SEQ ID NO: 14327 - protein, 15 aa, Homo Sapiens
KFVQSCIDWNREVLK

SEQ ID NO: 14328 - protein, 15 aa, Homo Sapiens
EVLKRELGLAECDII

SEQ ID NO: 14329 - protein, 15 aa, Homo Sapiens
RELGLAECDIIDIPQ

SEQ ID NO: 14330 - protein, 15 aa, Homo Sapiens
LGLAECDIIDIPQLF

SEQ ID NO: 14331 - protein, 15 aa, Homo Sapiens
AECDIIDIPQLFKTE

SEQ ID NO: 14332 - protein, 15 aa, Homo Sapiens
KTERKKATAFFPDLV

SEQ ID NO: 14333 - protein, 15 aa, Homo Sapiens
KATAFFPDLVNMLVL

SEQ ID NO: 14334 - protein, 15 aa, Homo Sapiens
LVLGKHLGIPKPFGP

SEQ ID NO: 14335 - protein, 15 aa, Homo Sapiens
LGKHLGIPKPFGPII

SEQ ID NO: 14336 - protein, 15 aa, Homo Sapiens
KPFGPIINGCCCLEE

SEQ ID NO: 14337 - protein, 15 aa, Homo Sapiens
PFGPIINGCCCLEEK

SEQ ID NO: 14338 - protein, 15 aa, Homo Sapiens
PIINGCCCLEEKVRS

SEQ ID NO: 14339 - protein, 15 aa, Homo Sapiens
IINGCCCLEEKVRSL

SEQ ID NO: 14340 - protein, 15 aa, Homo Sapiens
INGCCCLEEKVRSLL

SEQ ID NO: 14341 - protein, 15 aa, Homo Sapiens
LEEKVRSLLEPLGLH

SEQ ID NO: 14342 - protein, 15 aa, Homo Sapiens
KVRSLLEPLGLHCTF

SEQ ID NO: 14343 - protein, 15 aa, Homo Sapiens
SLLEPLGLHCTFIDD

SEQ ID NO: 14344 - protein, 15 aa, Homo Sapiens
GLHCTFIDDFTPYHM

SEQ ID NO: 14345 - protein, 15 aa, Homo Sapiens
LHCTFIDDFTPYHML

SEQ ID NO: 14346 - protein, 15 aa, Homo Sapiens
TFIDDFTPYHMLHGE

SEQ ID NO: 14347 - protein, 15 aa, Homo Sapiens
FIDDFTPYHMLHGEV

SEQ ID NO: 14348 - protein, 15 aa, Homo Sapiens
MLHGEVHCGTNVCRK

SEQ ID NO: 14349 - protein, 15 aa, Homo Sapiens
LHGEVHCGTNVCRKP

SEQ ID NO: 14350 - protein, 15 aa, Homo Sapiens
GEVHCGTNVCRKPFS

SEQ ID NO: 14351 - protein, 15 aa, Homo Sapiens
HCGTNVCRKPFSFKW

SEQ ID NO: 14352 - protein, 15 aa, Homo Sapiens
TNVCRKPFSFKWWNM

SEQ ID NO: 14353 - protein, 15 aa, Homo Sapiens
NVCRKPFSFKWWNMV

SEQ ID NO: 14354 - protein, 15 aa, Homo Sapiens
VCRKPFSFKWWNMVP

SEQ ID NO: 14355 - protein, 15 aa, Homo Sapiens
TSSYDAKRAQVFHIC

SEQ ID NO: 14356 - protein, 15 aa, Homo Sapiens
LQDFPYKRILGPDFG

SEQ ID NO: 14357 - protein, 15 aa, Homo Sapiens
DFGYVTREPRDRSVS

SEQ ID NO: 14358 - protein, 15 aa, Homo Sapiens
FKLFQEKQKCGHGRA

SEQ ID NO: 14359 - protein, 15 aa, Homo Sapiens
RNFVDKRQWVWGPSG

SEQ ID NO: 14360 - protein, 15 aa, Homo Sapiens
NQVLSNKDLINYNKF

SEQ ID NO: 14361 - protein, 15 aa, Homo Sapiens
NMLVLGKHLGIPKPF

SEQ ID NO: 14362 - protein, 15 aa, Homo Sapiens
SLQRIVRVSLEHPTS

SEQ ID NO: 14363 - protein, 15 aa, Homo Sapiens
ADTRRWRFDATLEII

SEQ ID NO: 14364 - protein, 15 aa, Homo Sapiens
CEGRQDRNFVDKRQW

SEQ ID NO: 14365 - protein, 15 aa, Homo Sapiens
ALFDDHKLVLHTSSY

SEQ ID NO: 14366 - protein, 15 aa, Homo Sapiens
SSYDAKRAQVFHICG

SEQ ID NO: 14367 - protein, 15 aa, Homo Sapiens
DVCEAYRHVLGQDKV

SEQ ID NO: 14368 - protein, 15 aa, Homo Sapiens
VSYEVPRLHGDEERF

SEQ ID NO: 14369 - protein, 15 aa, Homo Sapiens
VYVCRVRNNTCFVDA

SEQ ID NO: 14370 - protein, 15 aa, Homo Sapiens
AVAELARKAGCKLTI

SEQ ID NO: 14371 - protein, 15 aa, Homo Sapiens
ARKAGCKLTICPQAE

SEQ ID NO: 14372 - protein, 15 aa, Homo Sapiens
CPQAENRNDRWIQDE

SEQ ID NO: 14373 - protein, 15 aa, Homo Sapiens
YVQAPHKTLPVVFDS

SEQ ID NO: 14374 - protein, 15 aa, Homo Sapiens
VVFDSPRNGELQDFP

SEQ ID NO: 14375 - protein, 15 aa, Homo Sapiens
TREPRDRSVSGLDSF

SEQ ID NO: 14376 - protein, 15 aa, Homo Sapiens
LPGSSGRRVTQVVRD

SEQ ID NO: 14377 - protein, 15 aa, Homo Sapiens
RVTQVVRDFLHAQKV

SEQ ID NO: 14378 - protein, 15 aa, Homo Sapiens
VPAPDGKGFRMLLAS

SEQ ID NO: 14379 - protein, 15 aa, Homo Sapiens
PDGKGFRMLLASPGA

SEQ ID NO: 14380 - protein, 15 aa, Homo Sapiens
SPGACFKLFQEKQKC

SEQ ID NO: 14381 - protein, 15 aa, Homo Sapiens
QKCGHGRALLFQGVV

SEQ ID NO: 14382 - protein, 15 aa, Homo Sapiens
VDDEQVKTISINQVL

SEQ ID NO: 14383 - protein, 15 aa, Homo Sapiens
WNREVLKRELGLAEC

SEQ ID NO: 14384 - protein, 15 aa, Homo Sapiens
DIPQLFKTERKKATA

SEQ ID NO: 14385 - protein, 15 aa, Homo Sapiens
QLFKTERKKATAFFP

SEQ ID NO: 14386 - protein, 15 aa, Homo Sapiens
FKTERKKATAFFPDL

SEQ ID NO: 14387 - protein, 15 aa, Homo Sapiens
KHLGIPKPFGPIING

SEQ ID NO: 14388 - protein, 15 aa, Homo Sapiens
MERGRERADTRRWRF

SEQ ID NO: 14389 - protein, 15 aa, Homo Sapiens
RERADTRRWRFDATL

SEQ ID NO: 14390 - protein, 15 aa, Homo Sapiens
DLNCEGRQDRNFVDK

SEQ ID NO: 14391 - protein, 15 aa, Homo Sapiens
LLVNCDRDDPSCDVQ

SEQ ID NO: 14392 - protein, 15 aa, Homo Sapiens
LHGDEERFFVEGLSF

SEQ ID NO: 14393 - protein, 15 aa, Homo Sapiens
AENRNDRWIQDEMEL

SEQ ID NO: 14394 - protein, 15 aa, Homo Sapiens
QDFPYKRILGPDFGY

SEQ ID NO: 14395 - protein, 15 aa, Homo Sapiens
PVVANGKEYPLGRIL

SEQ ID NO: 14396 - protein, 15 aa, Homo Sapiens
KEYPLGRILIGGNLP

SEQ ID NO: 14397 - protein, 15 aa, Homo Sapiens
LFQEKQKCGHGRALL

SEQ ID NO: 14398 - protein, 15 aa, Homo Sapiens
DLINYNKFVQSCIDW

SEQ ID NO: 14399 - protein, 15 aa, Homo Sapiens
SCIDWNREVLKRELG

SEQ ID NO: 14400 - protein, 15 aa, Homo Sapiens
LFKTERKKATAFFPD

SEQ ID NO: 14401 - protein, 15 aa, Homo Sapiens
CLEEKVRSLLEPLGL

SEQ ID NO: 14402 - protein, 15 aa, Homo Sapiens
CGTNVCRKPFSFKWW

SEQ ID NO: 14403 - protein, 15 aa, Homo Sapiens
VAPWIMTPSTLAPLE

SEQ ID NO: 14404 - protein, 15 aa, Homo Sapiens
FRVAPWIMTPSTLAP

SEQ ID NO: 14405 - protein, 15 aa, Homo Sapiens
APLEVYVCRVRNNTC

SEQ ID NO: 14406 - protein, 15 aa, Homo Sapiens
VFRVAPWIMTPSTLA

SEQ ID NO: 14407 - protein, 15 aa, Homo Sapiens
APWIMTPSTLAPLEV

SEQ ID NO: 14408 - protein, 15 aa, Homo Sapiens
PWIMTPSTLAPLEVY

SEQ ID NO: 14409 - protein, 15 aa, Homo Sapiens
PSTLAPLEVYVCRVR

SEQ ID NO: 14410 - protein, 15 aa, Homo Sapiens
IMTPSTLAPLEVYVC

SEQ ID NO: 14411 - protein, 15 aa, Homo Sapiens
TLAPLEVYVCRVRNN

SEQ ID NO: 14412 - protein, 15 aa, Homo Sapiens
LAPLEVYVCRVRNNT

SEQ ID NO: 14413 - protein, 15 aa, Homo Sapiens
RVAPWIMTPSTLAPL

SEQ ID NO: 14414 - protein, 15 aa, Homo Sapiens
MTPSTLAPLEVYVCR

SEQ ID NO: 14415 - protein, 15 aa, Homo Sapiens
TPSTLAPLEVYVCRV

SEQ ID NO: 14416 - protein, 15 aa, Homo Sapiens
STLAPLEVYVCRVRN

SEQ ID NO: 14417 - protein, 15 aa, Homo Sapiens
VGHVDEFLSFVPVPD

SEQ ID NO: 14418 - protein, 15 aa, Homo Sapiens
VDEFLSFVPVPDGKG

SEQ ID NO: 14419 - protein, 15 aa, Homo Sapiens
FLSFVPVPDGKGFRM

SEQ ID NO: 14420 - protein, 15 aa, Homo Sapiens
DEFLSFVPVPDGKGF

SEQ ID NO: 14421 - protein, 15 aa, Homo Sapiens
FVPVPDGKGFRMLLA

SEQ ID NO: 14422 - protein, 15 aa, Homo Sapiens
AVGHVDEFLSFVPVP

SEQ ID NO: 14423 - protein, 15 aa, Homo Sapiens
GHVDEFLSFVPVPDG

SEQ ID NO: 14424 - protein, 15 aa, Homo Sapiens
PVPDGKGFRMLLASP

SEQ ID NO: 14425 - protein, 15 aa, Homo Sapiens
VPDGKGFRMLLASPG

SEQ ID NO: 14426 - protein, 15 aa, Homo Sapiens
LSFVPVPDGKGFRML

SEQ ID NO: 14427 - protein, 15 aa, Homo Sapiens
LAVGHVDEFLSFVPV

SEQ ID NO: 14428 - protein, 15 aa, Homo Sapiens
EFLSFVPVPDGKGFR

SEQ ID NO: 14429 - protein, 15 aa, Homo Sapiens
SFVPVPDGKGFRMLL

SEQ ID NO: 14430 - protein, 15 aa, Homo Sapiens
VPVPDGKGFRMLLAS

SEQ ID NO: 14431 - protein, 15 aa, Homo Sapiens
LVNMLVLGKHLGIPK

SEQ ID NO: 14432 - protein, 15 aa, Homo Sapiens
VDAVAELARKAGCKL

SEQ ID NO: 14433 - protein, 15 aa, Homo Sapiens
GPDFGYVTREPRDRS

SEQ ID NO: 14434 - protein, 15 aa, Homo Sapiens
FGYVTREPRDRSVSG

SEQ ID NO: 14435 - protein, 15 aa, Homo Sapiens
GRRVTQVVRDFLHAQ

SEQ ID NO: 14436 - protein, 15 aa, Homo Sapiens
VRDFLHAQKVQPPVE

SEQ ID NO: 14437 - protein, 15 aa, Homo Sapiens
FVDWLAVGHVDEFLS

SEQ ID NO: 14438 - protein, 15 aa, Homo Sapiens
IFTDTVVFRVAPWIM

SEQ ID NO: 14439 - protein, 15 aa, Homo Sapiens
LDSFGNLEVSPPVVA

SEQ ID NO: 14440 - protein, 15 aa, Homo Sapiens
GKGFRMLLASPGACF

SEQ ID NO: 14441 - protein, 15 aa, Homo Sapiens
DWNREVLKRELGLAE

SEQ ID NO: 14442 - protein, 15 aa, Homo Sapiens
IPQLFKTERKKATAF

SEQ ID NO: 14443 - protein, 15 aa, Homo Sapiens
LGYVQAPHKTLPVVF

SEQ ID NO: 14444 - protein, 15 aa, Homo Sapiens
RIVRVSLEHPTSAVC

SEQ ID NO: 14445 - protein, 15 aa, Homo Sapiens
VAGVETLVDIYGSVP

SEQ ID NO: 14446 - protein, 15 aa, Homo Sapiens
DATLEIIVVMNSPSN

SEQ ID NO: 14447 - protein, 15 aa, Homo Sapiens
GILLVNCDRDDPSCD

SEQ ID NO: 14448 - protein, 15 aa, Homo Sapiens
EDMSVMVLRTQGPAA

SEQ ID NO: 14449 - protein, 15 aa, Homo Sapiens
FDDHKLVLHTSSYDA

SEQ ID NO: 14450 - protein, 15 aa, Homo Sapiens
DAKRAQVFHICGPED

SEQ ID NO: 14451 - protein, 15 aa, Homo Sapiens
DKVSYEVPRLHGDEE

SEQ ID NO: 14452 - protein, 15 aa, Homo Sapiens
LEVYVCRVRNNTCFV

SEQ ID NO: 14453 - protein, 15 aa, Homo Sapiens
SPPVVANGKEYPLGR

SEQ ID NO: 14454 - protein, 15 aa, Homo Sapiens
IIDIPQLFKTERKKA

SEQ ID NO: 14455 - protein, 15 aa, Homo Sapiens
LGKHLGIPKPFGPII

SEQ ID NO: 14456 - protein, 15 aa, Homo Sapiens
VETLVDIYGSVPEGT

SEQ ID NO: 14457 - protein, 15 aa, Homo Sapiens
GTEMFEVYGTPGVDI

SEQ ID NO: 14458 - protein, 15 aa, Homo Sapiens
TLEIIVVMNSPSNDL

SEQ ID NO: 14459 - protein, 15 aa, Homo Sapiens
DMSVMVLRTQGPAAL

SEQ ID NO: 14460 - protein, 15 aa, Homo Sapiens
NTCFVDAVAELARKA

SEQ ID NO: 14461 - protein, 15 aa, Homo Sapiens
WLAVGHVDEFLSFVP

SEQ ID NO: 14462 - protein, 15 aa, Homo Sapiens
TAFFPDLVNMLVLGK

SEQ ID NO: 14463 - protein, 15 aa, Homo Sapiens
EEKVRSLLEPLGLHC

SEQ ID NO: 14464 - protein, 15 aa, Homo Sapiens
LQRIVRVSLEHPTSA

SEQ ID NO: 14465 - protein, 15 aa, Homo Sapiens
VDIYISPNMERGRER

SEQ ID NO: 14466 - protein, 15 aa, Homo Sapiens
EERFFVEGLSFPDAG

SEQ ID NO: 14467 - protein, 15 aa, Homo Sapiens
RFFVEGLSFPDAGFT

SEQ ID NO: 14468 - protein, 15 aa, Homo Sapiens
DAGFTGLISFHVTLL

SEQ ID NO: 14469 - protein, 15 aa, Homo Sapiens
ELGYVQAPHKTLPVV

SEQ ID NO: 14470 - protein, 15 aa, Homo Sapiens
DEFLSFVPAPDGKGF

SEQ ID NO: 14471 - protein, 15 aa, Homo Sapiens
FKLFQEKQKCGHGRA

SEQ ID NO: 14472 - protein, 15 aa, Homo Sapiens
ALLFQGVVDDEQVKT

SEQ ID NO: 14473 - protein, 15 aa, Homo Sapiens
PQLFKTERKKATAFF

SEQ ID NO: 14474 - protein, 15 aa, Homo Sapiens
IDDFTPYHMLHGEVH

SEQ ID NO: 14475 - protein, 15 aa, Homo Sapiens
QISYHSSHEPLPLAY

SEQ ID NO: 14476 - protein, 15 aa, Homo Sapiens
PLAYAVLYLTCVDIS

SEQ ID NO: 14477 - protein, 15 aa, Homo Sapiens
LISFHVTLLDDSNED

SEQ ID NO: 14478 - protein, 15 aa, Homo Sapiens
VAPWIMTPSTLPPLE

SEQ ID NO: 14479 - protein, 15 aa, Homo Sapiens
NDRWIQDEMELGYVQ

SEQ ID NO: 14480 - protein, 15 aa, Homo Sapiens
GKEYPLGRILIGGNL

SEQ ID NO: 14481 - protein, 15 aa, Homo Sapiens
FLSFVPAPDGKGFRM

SEQ ID NO: 14482 - protein, 15 aa, Homo Sapiens
GVVDDEQVKTISINQ

SEQ ID NO: 14483 - protein, 15 aa, Homo Sapiens
CCCLEEKVRSLLEPL

SEQ ID NO: 14484 - protein, 15 aa, Homo Sapiens
FTPYHMLHGEVHCGT

SEQ ID NO: 14485 - protein, 15 aa, Homo Sapiens
VDIYGSVPEGTEMFE

SEQ ID NO: 14486 - protein, 15 aa, Homo Sapiens
IYISPNMERGRERAD

SEQ ID NO: 14487 - protein, 15 aa, Homo Sapiens
ISPNMERGRERADTR

SEQ ID NO: 14488 - protein, 15 aa, Homo Sapiens
ERADTRRWRFDATLE

SEQ ID NO: 14489 - protein, 15 aa, Homo Sapiens
KRQWVWGPSGYGGIL

SEQ ID NO: 14490 - protein, 15 aa, Homo Sapiens
PSGYGGILLVNCDRD

SEQ ID NO: 14491 - protein, 15 aa, Homo Sapiens
LEDMSVMVLRTQGPA

SEQ ID NO: 14492 - protein, 15 aa, Homo Sapiens
PAALFDDHKLVLHTS

SEQ ID NO: 14493 - protein, 15 aa, Homo Sapiens
CEAYRHVLGQDKVSY

SEQ ID NO: 14494 - protein, 15 aa, Homo Sapiens
SPIFTDTVVFRVAPW

SEQ ID NO: 14495 - protein, 15 aa, Homo Sapiens
PIFTDTVVFRVAPWI

SEQ ID NO: 14496 - protein, 15 aa, Homo Sapiens
PPLEVYVCRVRNNTC

SEQ ID NO: 14497 - protein, 15 aa, Homo Sapiens
ELQDFPYKRILGPDF

SEQ ID NO: 14498 - protein, 15 aa, Homo Sapiens
LQDFPYKRILGPDFG

SEQ ID NO: 14499 - protein, 15 aa, Homo Sapiens
DFPYKRILGPDFGYV

SEQ ID NO: 14500 - protein, 15 aa, Homo Sapiens
FQEKQKCGHGRALLF

SEQ ID NO: 14501 - protein, 15 aa, Homo Sapiens
QLFKTERKKATAFFP

SEQ ID NO: 14502 - protein, 15 aa, Homo Sapiens
PKPFGPIINGCCCLE

SEQ ID NO: 14503 - protein, 15 aa, Homo Sapiens
NGCCCLEEKVRSLLE

SEQ ID NO: 14504 - protein, 15 aa, Homo Sapiens
YHMLHGEVHCGTNVC

SEQ ID NO: 14505 - protein, 15 aa, Homo Sapiens
VHCGTNVCRKPFSFK

SEQ ID NO: 14506 - protein, 15 aa, Homo Sapiens
VLYLTCVDISLDCDL

SEQ ID NO: 14507 - protein, 15 aa, Homo Sapiens
RQDRNFVDKRQWVWG

SEQ ID NO: 14508 - protein, 15 aa, Homo Sapiens
PEDVCEAYRHVLGQD

SEQ ID NO: 14509 - protein, 15 aa, Homo Sapiens
EDVCEAYRHVLGQDK

SEQ ID NO: 14510 - protein, 15 aa, Homo Sapiens
LPVVFDSPRNGELQD

SEQ ID NO: 14511 - protein, 15 aa, Homo Sapiens
YVTREPRDRSVSGLD

SEQ ID NO: 14512 - protein, 15 aa, Homo Sapiens
NGKEYPLGRILIGGN

SEQ ID NO: 14513 - protein, 15 aa, Homo Sapiens
QPPVELFVDWLAVGH

SEQ ID NO: 14514 - protein, 15 aa, Homo Sapiens
PVELFVDWLAVGHVD

SEQ ID NO: 14515 - protein, 15 aa, Homo Sapiens
NKDLINYNKFVQSCI

SEQ ID NO: 14516 - protein, 15 aa, Homo Sapiens
IDWNREVLKRELGLA

SEQ ID NO: 14517 - protein, 15 aa, Homo Sapiens
PDLVNMLVLGKHLGI

SEQ ID NO: 14518 - protein, 15 aa, Homo Sapiens
HCGTNVCRKPFSFKW

SEQ ID NO: 14519 - protein, 15 aa, Homo Sapiens
AGVETLVDIYGSVPE

SEQ ID NO: 14520 - protein, 15 aa, Homo Sapiens
VPEGTEMFEVYGTPG

SEQ ID NO: 14521 - protein, 15 aa, Homo Sapiens
ATLEIIVVMNSPSND

SEQ ID NO: 14522 - protein, 15 aa, Homo Sapiens
DSHVQISYHSSHEPL

SEQ ID NO: 14523 - protein, 15 aa, Homo Sapiens
DCDLNCEGRQDRNFV

SEQ ID NO: 14524 - protein, 15 aa, Homo Sapiens
YGGILLVNCDRDDPS

SEQ ID NO: 14525 - protein, 15 aa, Homo Sapiens
LFDDHKLVLHTSSYD

SEQ ID NO: 14526 - protein, 15 aa, Homo Sapiens
YRHVLGQDKVSYEVP

SEQ ID NO: 14527 - protein, 15 aa, Homo Sapiens
SFHVTLLDDSNEDFS

SEQ ID NO: 14528 - protein, 15 aa, Homo Sapiens
DTVVFRVAPWIMTPS

SEQ ID NO: 14529 - protein, 15 aa, Homo Sapiens
PHKTLPVVFDSPRNG

SEQ ID NO: 14530 - protein, 15 aa, Homo Sapiens
FGNLEVSPPVVANGK

SEQ ID NO: 14531 - protein, 15 aa, Homo Sapiens
NLEVSPPVVANGKEY

SEQ ID NO: 14532 - protein, 15 aa, Homo Sapiens
TQVVRDFLHAQKVQP

SEQ ID NO: 14533 - protein, 15 aa, Homo Sapiens
CIDWNREVLKRELGL

SEQ ID NO: 14534 - protein, 15 aa, Homo Sapiens
VNMLVLGKHLGIPKP

SEQ ID NO: 14535 - protein, 15 aa, Homo Sapiens
GLHCTFIDDFTPYHM

SEQ ID NO: 14536 - protein, 15 aa, Homo Sapiens
DFTPYHMLHGEVHCG

SEQ ID NO: 14537 - protein, 15 aa, Homo Sapiens
AVCVAGVETLVDIYG

SEQ ID NO: 14538 - protein, 15 aa, Homo Sapiens
VYGTPGVDIYISPNM

SEQ ID NO: 14539 - protein, 15 aa, Homo Sapiens
LEIIVVMNSPSNDLN

SEQ ID NO: 14540 - protein, 15 aa, Homo Sapiens
SNDLNDSHVQISYHS

SEQ ID NO: 14541 - protein, 15 aa, Homo Sapiens
YAVLYLTCVDISLDC

SEQ ID NO: 14542 - protein, 15 aa, Homo Sapiens
LQDLEDMSVMVLRTQ

SEQ ID NO: 14543 - protein, 15 aa, Homo Sapiens
RAQVFHICGPEDVCE

SEQ ID NO: 14544 - protein, 15 aa, Homo Sapiens
VLGQDKVSYEVPRLH

SEQ ID NO: 14545 - protein, 15 aa, Homo Sapiens
PSTLPPLEVYVCRVR

SEQ ID NO: 14546 - protein, 15 aa, Homo Sapiens
HKTLPVVFDSPRNGE

SEQ ID NO: 14547 - protein, 15 aa, Homo Sapiens
TLPVVFDSPRNGELQ

SEQ ID NO: 14548 - protein, 15 aa, Homo Sapiens
PLGRILIGGNLPGSS

SEQ ID NO: 14549 - protein, 15 aa, Homo Sapiens
VGHVDEFLSFVPAPD

SEQ ID NO: 14550 - protein, 15 aa, Homo Sapiens
DGKGFRMLLASPGAC

SEQ ID NO: 14551 - protein, 15 aa, Homo Sapiens
CFKLFQEKQKCGHGR

SEQ ID NO: 14552 - protein, 15 aa, Homo Sapiens
QVKTISINQVLSNKD

SEQ ID NO: 14553 - protein, 15 aa, Homo Sapiens
TISINQVLSNKDLIN

SEQ ID NO: 14554 - protein, 15 aa, Homo Sapiens
NREVLKRELGLAECD

SEQ ID NO: 14555 - protein, 15 aa, Homo Sapiens
NMLVLGKHLGIPKPF

SEQ ID NO: 14556 - protein, 15 aa, Homo Sapiens
LVLGKHLGIPKPFGP

SEQ ID NO: 14557 - protein, 15 aa, Homo Sapiens
IVRVSLEHPTSAVCV

SEQ ID NO: 14558 - protein, 15 aa, Homo Sapiens
NDSHVQISYHSSHEP

SEQ ID NO: 14559 - protein, 15 aa, Homo Sapiens
HVQISYHSSHEPLPL

SEQ ID NO: 14560 - protein, 15 aa, Homo Sapiens
HSSHEPLPLAYAVLY

SEQ ID NO: 14561 - protein, 15 aa, Homo Sapiens
AYAVLYLTCVDISLD

SEQ ID NO: 14562 - protein, 15 aa, Homo Sapiens
AVLYLTCVDISLDCD

SEQ ID NO: 14563 - protein, 15 aa, Homo Sapiens
DISLDCDLNCEGRQD

SEQ ID NO: 14564 - protein, 15 aa, Homo Sapiens
RNFVDKRQWVWGPSG

SEQ ID NO: 14565 - protein, 15 aa, Homo Sapiens
VDKRQWVWGPSGYGG

SEQ ID NO: 14566 - protein, 15 aa, Homo Sapiens
RQWVWGPSGYGGILL

SEQ ID NO: 14567 - protein, 15 aa, Homo Sapiens
ILLVNCDRDDPSCDV

SEQ ID NO: 14568 - protein, 15 aa, Homo Sapiens
DQHVHCLQDLEDMSV

SEQ ID NO: 14569 - protein, 15 aa, Homo Sapiens
VHCLQDLEDMSVMVL

SEQ ID NO: 14570 - protein, 15 aa, Homo Sapiens
MSVMVLRTQGPAALF

SEQ ID NO: 14571 - protein, 15 aa, Homo Sapiens
SVMVLRTQGPAALFD

SEQ ID NO: 14572 - protein, 15 aa, Homo Sapiens
HKLVLHTSSYDAKRA

SEQ ID NO: 14573 - protein, 15 aa, Homo Sapiens
SYEVPRLHGDEERFF

SEQ ID NO: 14574 - protein, 15 aa, Homo Sapiens
VTLLDDSNEDFSASP

SEQ ID NO: 14575 - protein, 15 aa, Homo Sapiens
VFRVAPWIMTPSTLP

SEQ ID NO: 14576 - protein, 15 aa, Homo Sapiens
APWIMTPSTLPPLEV

SEQ ID NO: 14577 - protein, 15 aa, Homo Sapiens
EVYVCRVRNNTCFVD

SEQ ID NO: 14578 - protein, 15 aa, Homo Sapiens
TCFVDAVAELARKAG

SEQ ID NO: 14579 - protein, 15 aa, Homo Sapiens
IQDEMELGYVQAPHK

SEQ ID NO: 14580 - protein, 15 aa, Homo Sapiens
QDEMELGYVQAPHKT

SEQ ID NO: 14581 - protein, 15 aa, Homo Sapiens
EMELGYVQAPHKTLP

SEQ ID NO: 14582 - protein, 15 aa, Homo Sapiens
FPYKRILGPDFGYVT

SEQ ID NO: 14583 - protein, 15 aa, Homo Sapiens
EPRDRSVSGLDSFGN

SEQ ID NO: 14584 - protein, 15 aa, Homo Sapiens
DRSVSGLDSFGNLEV

SEQ ID NO: 14585 - protein, 15 aa, Homo Sapiens
EYPLGRILIGGNLPG

SEQ ID NO: 14586 - protein, 15 aa, Homo Sapiens
LGRILIGGNLPGSSG

SEQ ID NO: 14587 - protein, 15 aa, Homo Sapiens
GRILIGGNLPGSSGR

SEQ ID NO: 14588 - protein, 15 aa, Homo Sapiens
RILIGGNLPGSSGRR

SEQ ID NO: 14589 - protein, 15 aa, Homo Sapiens
ILIGGNLPGSSGRRV

SEQ ID NO: 14590 - protein, 15 aa, Homo Sapiens
RDFLHAQKVQPPVEL

SEQ ID NO: 14591 - protein, 15 aa, Homo Sapiens
ELFVDWLAVGHVDEF

SEQ ID NO: 14592 - protein, 15 aa, Homo Sapiens
GHVDEFLSFVPAPDG

SEQ ID NO: 14593 - protein, 15 aa, Homo Sapiens
VDEFLSFVPAPDGKG

SEQ ID NO: 14594 - protein, 15 aa, Homo Sapiens
KGFRMLLASPGACFK

SEQ ID NO: 14595 - protein, 15 aa, Homo Sapiens
DEQVKTISINQVLSN

SEQ ID NO: 14596 - protein, 15 aa, Homo Sapiens
KDLINYNKFVQSCID

SEQ ID NO: 14597 - protein, 15 aa, Homo Sapiens
LINYNKFVQSCIDWN

SEQ ID NO: 14598 - protein, 15 aa, Homo Sapiens
ECDIIDIPQLFKTER

SEQ ID NO: 14599 - protein, 15 aa, Homo Sapiens
FPDLVNMLVLGKHLG

SEQ ID NO: 14600 - protein, 15 aa, Homo Sapiens
GKHLGIPKPFGPIIN

SEQ ID NO: 14601 - protein, 15 aa, Homo Sapiens
RSLLEPLGLHCTFID

SEQ ID NO: 14602 - protein, 15 aa, Homo Sapiens
PYHMLHGEVHCGTNV

SEQ ID NO: 14603 - protein, 15 aa, Homo Sapiens
TEMFEVYGTPGVDIY

SEQ ID NO: 14604 - protein, 15 aa, Homo Sapiens
FEVYGTPGVDIYISP

SEQ ID NO: 14605 - protein, 15 aa, Homo Sapiens
RWRFDATLEIIVVMN

SEQ ID NO: 14606 - protein, 15 aa, Homo Sapiens
DRNFVDKRQWVWGPS

SEQ ID NO: 14607 - protein, 15 aa, Homo Sapiens
QDNCDQHVHCLQDLE

SEQ ID NO: 14608 - protein, 15 aa, Homo Sapiens
AALFDDHKLVLHTSS

SEQ ID NO: 14609 - protein, 15 aa, Homo Sapiens
TSSYDAKRAQVFHIC

SEQ ID NO: 14610 - protein, 15 aa, Homo Sapiens
KVSYEVPRLHGDEER

SEQ ID NO: 14611 - protein, 15 aa, Homo Sapiens
TVVFRVAPWIMTPST

SEQ ID NO: 14612 - protein, 15 aa, Homo Sapiens
LPPLEVYVCRVRNNT

SEQ ID NO: 14613 - protein, 15 aa, Homo Sapiens
VRNNTCFVDAVAELA

SEQ ID NO: 14614 - protein, 15 aa, Homo Sapiens
DFGYVTREPRDRSVS

SEQ ID NO: 14615 - protein, 15 aa, Homo Sapiens
ATAFFPDLVNMLVLG

SEQ ID NO: 14616 - protein, 15 aa, Homo Sapiens
LEHPTSAVCVAGVET

SEQ ID NO: 14617 - protein, 15 aa, Homo Sapiens
GRERADTRRWRFDAT

SEQ ID NO: 14618 - protein, 15 aa, Homo Sapiens
TRRWRFDATLEIIVV

SEQ ID NO: 14619 - protein, 15 aa, Homo Sapiens
QDRNFVDKRQWVWGP

SEQ ID NO: 14620 - protein, 15 aa, Homo Sapiens
QWVWGPSGYGGILLV

SEQ ID NO: 14621 - protein, 15 aa, Homo Sapiens
AQVFHICGPEDVCEA

SEQ ID NO: 14622 - protein, 15 aa, Homo Sapiens
QDKVSYEVPRLHGDE

SEQ ID NO: 14623 - protein, 15 aa, Homo Sapiens
ERFFVEGLSFPDAGF

SEQ ID NO: 14624 - protein, 15 aa, Homo Sapiens
GLSFPDAGFTGLISF

SEQ ID NO: 14625 - protein, 15 aa, Homo Sapiens
NEDFSASPIFTDTVV

SEQ ID NO: 14626 - protein, 15 aa, Homo Sapiens
APHKTLPVVFDSPRN

SEQ ID NO: 14627 - protein, 15 aa, Homo Sapiens
PVVFDSPRNGELQDF

SEQ ID NO: 14628 - protein, 15 aa, Homo Sapiens
GELQDFPYKRILGPD

SEQ ID NO: 14629 - protein, 15 aa, Homo Sapiens
LGPDFGYVTREPRDR

SEQ ID NO: 14630 - protein, 15 aa, Homo Sapiens
GNLPGSSGRRVTQVV

SEQ ID NO: 14631 - protein, 15 aa, Homo Sapiens
VELFVDWLAVGHVDE

SEQ ID NO: 14632 - protein, 15 aa, Homo Sapiens
GACFKLFQEKQKCGH

SEQ ID NO: 14633 - protein, 15 aa, Homo Sapiens
YNKFVQSCIDWNREV

SEQ ID NO: 14634 - protein, 15 aa, Homo Sapiens
HCTFIDDFTPYHMLH

SEQ ID NO: 14635 - protein, 15 aa, Homo Sapiens
FIDDFTPYHMLHGEV

SEQ ID NO: 14636 - protein, 15 aa, Homo Sapiens
EVHCGTNVCRKPFSF

SEQ ID NO: 14637 - protein, 15 aa, Homo Sapiens
RGRERADTRRWRFDA

SEQ ID NO: 14638 - protein, 15 aa, Homo Sapiens
PLPLAYAVLYLTCVD

SEQ ID NO: 14639 - protein, 15 aa, Homo Sapiens
GPAALFDDHKLVLHT

SEQ ID NO: 14640 - protein, 15 aa, Homo Sapiens
LHTSSYDAKRAQVFH

SEQ ID NO: 14641 - protein, 15 aa, Homo Sapiens
GDEERFFVEGLSFPD

SEQ ID NO: 14642 - protein, 15 aa, Homo Sapiens
TGLISFHVTLLDDSN

SEQ ID NO: 14643 - protein, 15 aa, Homo Sapiens
PQAENRNDRWIQDEM

SEQ ID NO: 14644 - protein, 15 aa, Homo Sapiens
GGNLPGSSGRRVTQV

SEQ ID NO: 14645 - protein, 15 aa, Homo Sapiens
PAPDGKGFRMLLASP

SEQ ID NO: 14646 - protein, 15 aa, Homo Sapiens
ACFKLFQEKQKCGHG

SEQ ID NO: 14647 - protein, 15 aa, Homo Sapiens
EKQKCGHGRALLFQG

SEQ ID NO: 14648 - protein, 15 aa, Homo Sapiens
RALLFQGVVDDEQVK

SEQ ID NO: 14649 - protein, 15 aa, Homo Sapiens
SINQVLSNKDLINYN

SEQ ID NO: 14650 - protein, 15 aa, Homo Sapiens
VQSCIDWNREVLKRE

SEQ ID NO: 14651 - protein, 15 aa, Homo Sapiens
LVDIYGSVPEGTEMF

SEQ ID NO: 14652 - protein, 15 aa, Homo Sapiens
EGTEMFEVYGTPGVD

SEQ ID NO: 14653 - protein, 15 aa, Homo Sapiens
PNMERGRERADTRRW

SEQ ID NO: 14654 - protein, 15 aa, Homo Sapiens
PSNDLNDSHVQISYH

SEQ ID NO: 14655 - protein, 15 aa, Homo Sapiens
VQISYHSSHEPLPLA

SEQ ID NO: 14656 - protein, 15 aa, Homo Sapiens
LNCEGRQDRNFVDKR

SEQ ID NO: 14657 - protein, 15 aa, Homo Sapiens
FVDKRQWVWGPSGYG

SEQ ID NO: 14658 - protein, 15 aa, Homo Sapiens
GYGGILLVNCDRDDP

SEQ ID NO: 14659 - protein, 15 aa, Homo Sapiens
GGILLVNCDRDDPSC

SEQ ID NO: 14660 - protein, 15 aa, Homo Sapiens
DVQDNCDQHVHCLQD

SEQ ID NO: 14661 - protein, 15 aa, Homo Sapiens
DLEDMSVMVLRTQGP

SEQ ID NO: 14662 - protein, 15 aa, Homo Sapiens
VLHTSSYDAKRAQVF

SEQ ID NO: 14663 - protein, 15 aa, Homo Sapiens
HTSSYDAKRAQVFHI

SEQ ID NO: 14664 - protein, 15 aa, Homo Sapiens
EAYRHVLGQDKVSYE

SEQ ID NO: 14665 - protein, 15 aa, Homo Sapiens
VSYEVPRLHGDEERF

SEQ ID NO: 14666 - protein, 15 aa, Homo Sapiens
PRLHGDEERFFVEGL

SEQ ID NO: 14667 - protein, 15 aa, Homo Sapiens
GFTGLISFHVTLLDD

SEQ ID NO: 14668 - protein, 15 aa, Homo Sapiens
TDTVVFRVAPWIMTP

SEQ ID NO: 14669 - protein, 15 aa, Homo Sapiens
PWIMTPSTLPPLEVY

SEQ ID NO: 14670 - protein, 15 aa, Homo Sapiens
TLPPLEVYVCRVRNN

SEQ ID NO: 14671 - protein, 15 aa, Homo Sapiens
PLEVYVCRVRNNTCF

SEQ ID NO: 14672 - protein, 15 aa, Homo Sapiens
FVDAVAELARKAGCK

SEQ ID NO: 14673 - protein, 15 aa, Homo Sapiens
DAVAELARKAGCKLT

SEQ ID NO: 14674 - protein, 15 aa, Homo Sapiens
ELARKAGCKLTICPQ

SEQ ID NO: 14675 - protein, 15 aa, Homo Sapiens
GCKLTICPQAENRND

SEQ ID NO: 14676 - protein, 15 aa, Homo Sapiens
KLTICPQAENRNDRW

SEQ ID NO: 14677 - protein, 15 aa, Homo Sapiens
TICPQAENRNDRWIQ

SEQ ID NO: 14678 - protein, 15 aa, Homo Sapiens
NGELQDFPYKRILGP

SEQ ID NO: 14679 - protein, 15 aa, Homo Sapiens
LEVSPPVVANGKEYP

SEQ ID NO: 14680 - protein, 15 aa, Homo Sapiens
EVSPPVVANGKEYPL

SEQ ID NO: 14681 - protein, 15 aa, Homo Sapiens
NLPGSSGRRVTQVVR

SEQ ID NO: 14682 - protein, 15 aa, Homo Sapiens
RRVTQVVRDFLHAQK

SEQ ID NO: 14683 - protein, 15 aa, Homo Sapiens
AQKVQPPVELFVDWL

SEQ ID NO: 14684 - protein, 15 aa, Homo Sapiens
SFVPAPDGKGFRMLL

SEQ ID NO: 14685 - protein, 15 aa, Homo Sapiens
LASPGACFKLFQEKQ

SEQ ID NO: 14686 - protein, 15 aa, Homo Sapiens
PGACFKLFQEKQKCG

SEQ ID NO: 14687 - protein, 15 aa, Homo Sapiens
KFVQSCIDWNREVLK

SEQ ID NO: 14688 - protein, 15 aa, Homo Sapiens
FFPDLVNMLVLGKHL

SEQ ID NO: 14689 - protein, 15 aa, Homo Sapiens
SLLEPLGLHCTFIDD

SEQ ID NO: 14690 - protein, 15 aa, Homo Sapiens
VCRKPFSFKWWNMVP

SEQ ID NO: 14691 - protein, 15 aa, Homo Sapiens
MSLQRIVRVSLEHPT

SEQ ID NO: 14692 - protein, 15 aa, Homo Sapiens
QRIVRVSLEHPTSAV

SEQ ID NO: 14693 - protein, 15 aa, Homo Sapiens
RVSLEHPTSAVCVAG

SEQ ID NO: 14694 - protein, 15 aa, Homo Sapiens
SLEHPTSAVCVAGVE

SEQ ID NO: 14695 - protein, 15 aa, Homo Sapiens
TSAVCVAGVETLVDI

SEQ ID NO: 14696 - protein, 15 aa, Homo Sapiens
YGTPGVDIYISPNME

SEQ ID NO: 14697 - protein, 15 aa, Homo Sapiens
DIYISPNMERGRERA

SEQ ID NO: 14698 - protein, 15 aa, Homo Sapiens
SPNMERGRERADTRR

SEQ ID NO: 14699 - protein, 15 aa, Homo Sapiens
WRFDATLEIIVVMNS

SEQ ID NO: 14700 - protein, 15 aa, Homo Sapiens
IVVMNSPSNDLNDSH

SEQ ID NO: 14701 - protein, 15 aa, Homo Sapiens
LNDSHVQISYHSSHE

SEQ ID NO: 14702 - protein, 15 aa, Homo Sapiens
SYHSSHEPLPLAYAV

SEQ ID NO: 14703 - protein, 15 aa, Homo Sapiens
SHEPLPLAYAVLYLT

SEQ ID NO: 14704 - protein, 15 aa, Homo Sapiens
HEPLPLAYAVLYLTC

SEQ ID NO: 14705 - protein, 15 aa, Homo Sapiens
TCVDISLDCDLNCEG

SEQ ID NO: 14706 - protein, 15 aa, Homo Sapiens
DDHKLVLHTSSYDAK

SEQ ID NO: 14707 - protein, 15 aa, Homo Sapiens
AKRAQVFHICGPEDV

SEQ ID NO: 14708 - protein, 15 aa, Homo Sapiens
AYRHVLGQDKVSYEV

SEQ ID NO: 14709 - protein, 15 aa, Homo Sapiens
VPRLHGDEERFFVEG

SEQ ID NO: 14710 - protein, 15 aa, Homo Sapiens
DEERFFVEGLSFPDA

SEQ ID NO: 14711 - protein, 15 aa, Homo Sapiens
EGLSFPDAGFTGLIS

SEQ ID NO: 14712 - protein, 15 aa, Homo Sapiens
SFPDAGFTGLISFHV

SEQ ID NO: 14713 - protein, 15 aa, Homo Sapiens
AGFTGLISFHVTLLD

SEQ ID NO: 14714 - protein, 15 aa, Homo Sapiens
FTGLISFHVTLLDDS

SEQ ID NO: 14715 - protein, 15 aa, Homo Sapiens
GLISFHVTLLDDSNE

SEQ ID NO: 14716 - protein, 15 aa, Homo Sapiens
ASPIFTDTVVFRVAP

SEQ ID NO: 14717 - protein, 15 aa, Homo Sapiens
VCRVRNNTCFVDAVA

SEQ ID NO: 14718 - protein, 15 aa, Homo Sapiens
VAELARKAGCKLTIC

SEQ ID NO: 14719 - protein, 15 aa, Homo Sapiens
KRILGPDFGYVTREP

SEQ ID NO: 14720 - protein, 15 aa, Homo Sapiens
SGLDSFGNLEVSPPV

SEQ ID NO: 14721 - protein, 15 aa, Homo Sapiens
GLDSFGNLEVSPPVV

SEQ ID NO: 14722 - protein, 15 aa, Homo Sapiens
SFGNLEVSPPVVANG

SEQ ID NO: 14723 - protein, 15 aa, Homo Sapiens
PVVANGKEYPLGRIL

SEQ ID NO: 14724 - protein, 15 aa, Homo Sapiens
GSSGRRVTQVVRDFL

SEQ ID NO: 14725 - protein, 15 aa, Homo Sapiens
RVTQVVRDFLHAQKV

SEQ ID NO: 14726 - protein, 15 aa, Homo Sapiens
QVVRDFLHAQKVQPP

SEQ ID NO: 14727 - protein, 15 aa, Homo Sapiens
FLHAQKVQPPVELFV

SEQ ID NO: 14728 - protein, 15 aa, Homo Sapiens
QKVQPPVELFVDWLA

SEQ ID NO: 14729 - protein, 15 aa, Homo Sapiens
VDWLAVGHVDEFLSF

SEQ ID NO: 14730 - protein, 15 aa, Homo Sapiens
HVDEFLSFVPAPDGK

SEQ ID NO: 14731 - protein, 15 aa, Homo Sapiens
APDGKGFRMLLASPG

SEQ ID NO: 14732 - protein, 15 aa, Homo Sapiens
GHGRALLFQGVVDDE

SEQ ID NO: 14733 - protein, 15 aa, Homo Sapiens
LLFQGVVDDEQVKTI

SEQ ID NO: 14734 - protein, 15 aa, Homo Sapiens
FQGVVDDEQVKTISI

SEQ ID NO: 14735 - protein, 15 aa, Homo Sapiens
ISINQVLSNKDLINY

SEQ ID NO: 14736 - protein, 15 aa, Homo Sapiens
INQVLSNKDLINYNK

SEQ ID NO: 14737 - protein, 15 aa, Homo Sapiens
LSNKDLINYNKFVQS

SEQ ID NO: 14738 - protein, 15 aa, Homo Sapiens
INYNKFVQSCIDWNR

SEQ ID NO: 14739 - protein, 15 aa, Homo Sapiens
QSCIDWNREVLKREL

SEQ ID NO: 14740 - protein, 15 aa, Homo Sapiens
KRELGLAECDIIDIP

SEQ ID NO: 14741 - protein, 15 aa, Homo Sapiens
LGLAECDIIDIPQLF

SEQ ID NO: 14742 - protein, 15 aa, Homo Sapiens
CDIIDIPQLFKTERK

SEQ ID NO: 14743 - protein, 15 aa, Homo Sapiens
AFFPDLVNMLVLGKH

SEQ ID NO: 14744 - protein, 15 aa, Homo Sapiens
HLGIPKPFGPIINGC

SEQ ID NO: 14745 - protein, 15 aa, Homo Sapiens
FGPIINGCCCLEEKV

SEQ ID NO: 14746 - protein, 15 aa, Homo Sapiens
INGCCCLEEKVRSLL

SEQ ID NO: 14747 - protein, 15 aa, Homo Sapiens
CCLEEKVRSLLEPLG

SEQ ID NO: 14748 - protein, 15 aa, Homo Sapiens
CLEEKVRSLLEPLGL

SEQ ID NO: 14749 - protein, 15 aa, Homo Sapiens
LEPLGLHCTFIDDFT

SEQ ID NO: 14750 - protein, 15 aa, Homo Sapiens
EHPTSAVCVAGVETL

SEQ ID NO: 14751 - protein, 15 aa, Homo Sapiens
PTSAVCVAGVETLVD

SEQ ID NO: 14752 - protein, 15 aa, Homo Sapiens
ETLVDIYGSVPEGTE

SEQ ID NO: 14753 - protein, 15 aa, Homo Sapiens
TLVDIYGSVPEGTEM

SEQ ID NO: 14754 - protein, 15 aa, Homo Sapiens
YGSVPEGTEMFEVYG

SEQ ID NO: 14755 - protein, 15 aa, Homo Sapiens
MFEVYGTPGVDIYIS

SEQ ID NO: 14756 - protein, 15 aa, Homo Sapiens
GTPGVDIYISPNMER

SEQ ID NO: 14757 - protein, 15 aa, Homo Sapiens
TPGVDIYISPNMERG

SEQ ID NO: 14758 - protein, 15 aa, Homo Sapiens
PGVDIYISPNMERGR

SEQ ID NO: 14759 - protein, 15 aa, Homo Sapiens
GVDIYISPNMERGRE

SEQ ID NO: 14760 - protein, 15 aa, Homo Sapiens
FDATLEIIVVMNSPS

SEQ ID NO: 14761 - protein, 15 aa, Homo Sapiens
EIIVVMNSPSNDLND

SEQ ID NO: 14762 - protein, 15 aa, Homo Sapiens
IIVVMNSPSNDLNDS

SEQ ID NO: 14763 - protein, 15 aa, Homo Sapiens
VMNSPSNDLNDSHVQ

SEQ ID NO: 14764 - protein, 15 aa, Homo Sapiens
NSPSNDLNDSHVQIS

SEQ ID NO: 14765 - protein, 15 aa, Homo Sapiens
DLNDSHVQISYHSSH

SEQ ID NO: 14766 - protein, 15 aa, Homo Sapiens
LPLAYAVLYLTCVDI

SEQ ID NO: 14767 - protein, 15 aa, Homo Sapiens
YLTCVDISLDCDLNC

SEQ ID NO: 14768 - protein, 15 aa, Homo Sapiens
LTCVDISLDCDLNCE

SEQ ID NO: 14769 - protein, 15 aa, Homo Sapiens
CVDISLDCDLNCEGR

SEQ ID NO: 14770 - protein, 15 aa, Homo Sapiens
ISLDCDLNCEGRQDR

SEQ ID NO: 14771 - protein, 15 aa, Homo Sapiens
NFVDKRQWVWGPSGY

SEQ ID NO: 14772 - protein, 15 aa, Homo Sapiens
SGYGGILLVNCDRDD

SEQ ID NO: 14773 - protein, 15 aa, Homo Sapiens
DDPSCDVQDNCDQHV

SEQ ID NO: 14774 - protein, 15 aa, Homo Sapiens
SCDVQDNCDQHVHCL

SEQ ID NO: 14775 - protein, 15 aa, Homo Sapiens
DNCDQHVHCLQDLED

SEQ ID NO: 14776 - protein, 15 aa, Homo Sapiens
HVHCLQDLEDMSVMV

SEQ ID NO: 14777 - protein, 15 aa, Homo Sapiens
VMVLRTQGPAALFDD

SEQ ID NO: 14778 - protein, 15 aa, Homo Sapiens
TQGPAALFDDHKLVL

SEQ ID NO: 14779 - protein, 15 aa, Homo Sapiens
DHKLVLHTSSYDAKR

SEQ ID NO: 14780 - protein, 15 aa, Homo Sapiens
KLVLHTSSYDAKRAQ

SEQ ID NO: 14781 - protein, 15 aa, Homo Sapiens
VFHICGPEDVCEAYR

SEQ ID NO: 14782 - protein, 15 aa, Homo Sapiens
FHICGPEDVCEAYRH

SEQ ID NO: 14783 - protein, 15 aa, Homo Sapiens
ICGPEDVCEAYRHVL

SEQ ID NO: 14784 - protein, 15 aa, Homo Sapiens
RHVLGQDKVSYEVPR

SEQ ID NO: 14785 - protein, 15 aa, Homo Sapiens
LHGDEERFFVEGLSF

SEQ ID NO: 14786 - protein, 15 aa, Homo Sapiens
FFVEGLSFPDAGFTG

SEQ ID NO: 14787 - protein, 15 aa, Homo Sapiens
VEGLSFPDAGFTGLI

SEQ ID NO: 14788 - protein, 15 aa, Homo Sapiens
ISFHVTLLDDSNEDF

SEQ ID NO: 14789 - protein, 15 aa, Homo Sapiens
HVTLLDDSNEDFSAS

SEQ ID NO: 14790 - protein, 15 aa, Homo Sapiens
TLLDDSNEDFSASPI

SEQ ID NO: 14791 - protein, 15 aa, Homo Sapiens
LLDDSNEDFSASPIF

SEQ ID NO: 14792 - protein, 15 aa, Homo Sapiens
LDDSNEDFSASPIFT

SEQ ID NO: 14793 - protein, 15 aa, Homo Sapiens
DFSASPIFTDTVVFR

SEQ ID NO: 14794 - protein, 15 aa, Homo Sapiens
VVFRVAPWIMTPSTL

SEQ ID NO: 14795 - protein, 15 aa, Homo Sapiens
FRVAPWIMTPSTLPP

SEQ ID NO: 14796 - protein, 15 aa, Homo Sapiens
RVAPWIMTPSTLPPL

SEQ ID NO: 14797 - protein, 15 aa, Homo Sapiens
IMTPSTLPPLEVYVC

SEQ ID NO: 14798 - protein, 15 aa, Homo Sapiens
CRVRNNTCFVDAVAE

SEQ ID NO: 14799 - protein, 15 aa, Homo Sapiens
RNNTCFVDAVAELAR

SEQ ID NO: 14800 - protein, 15 aa, Homo Sapiens
ARKAGCKLTICPQAE

SEQ ID NO: 14801 - protein, 15 aa, Homo Sapiens
RKAGCKLTICPQAEN

SEQ ID NO: 14802 - protein, 15 aa, Homo Sapiens
KAGCKLTICPQAENR

SEQ ID NO: 14803 - protein, 15 aa, Homo Sapiens
AGCKLTICPQAENRN

SEQ ID NO: 14804 - protein, 15 aa, Homo Sapiens
NRNDRWIQDEMELGY

SEQ ID NO: 14805 - protein, 15 aa, Homo Sapiens
DRWIQDEMELGYVQA

SEQ ID NO: 14806 - protein, 15 aa, Homo Sapiens
RWIQDEMELGYVQAP

SEQ ID NO: 14807 - protein, 15 aa, Homo Sapiens
QAPHKTLPVVFDSPR

SEQ ID NO: 14808 - protein, 15 aa, Homo Sapiens
DSPRNGELQDFPYKR

SEQ ID NO: 14809 - protein, 15 aa, Homo Sapiens
SPRNGELQDFPYKRI

SEQ ID NO: 14810 - protein, 15 aa, Homo Sapiens
YKRILGPDFGYVTRE

SEQ ID NO: 14811 - protein, 15 aa, Homo Sapiens
VTREPRDRSVSGLDS

SEQ ID NO: 14812 - protein, 15 aa, Homo Sapiens
RDRSVSGLDSFGNLE

SEQ ID NO: 14813 - protein, 15 aa, Homo Sapiens
VSGLDSFGNLEVSPP

SEQ ID NO: 14814 - protein, 15 aa, Homo Sapiens
PPVVANGKEYPLGRI

SEQ ID NO: 14815 - protein, 15 aa, Homo Sapiens
KEYPLGRILIGGNLP

SEQ ID NO: 14816 - protein, 15 aa, Homo Sapiens
YPLGRILIGGNLPGS

SEQ ID NO: 14817 - protein, 15 aa, Homo Sapiens
VTQVVRDFLHAQKVQ

SEQ ID NO: 14818 - protein, 15 aa, Homo Sapiens
VQPPVELFVDWLAVG

SEQ ID NO: 14819 - protein, 15 aa, Homo Sapiens
PPVELFVDWLAVGHV

SEQ ID NO: 14820 - protein, 15 aa, Homo Sapiens
LSFVPAPDGKGFRML

SEQ ID NO: 14821 - protein, 15 aa, Homo Sapiens
PDGKGFRMLLASPGA

SEQ ID NO: 14822 - protein, 15 aa, Homo Sapiens
GFRMLLASPGACFKL

SEQ ID NO: 14823 - protein, 15 aa, Homo Sapiens
FRMLLASPGACFKLF

SEQ ID NO: 14824 - protein, 15 aa, Homo Sapiens
RMLLASPGACFKLFQ

SEQ ID NO: 14825 - protein, 15 aa, Homo Sapiens
KLFQEKQKCGHGRAL

SEQ ID NO: 14826 - protein, 15 aa, Homo Sapiens
KCGHGRALLFQGVVD

SEQ ID NO: 14827 - protein, 15 aa, Homo Sapiens
CGHGRALLFQGVVDD

SEQ ID NO: 14828 - protein, 15 aa, Homo Sapiens
GRALLFQGVVDDEQV

SEQ ID NO: 14829 - protein, 15 aa, Homo Sapiens
QGVVDDEQVKTISIN

SEQ ID NO: 14830 - protein, 15 aa, Homo Sapiens
VVDDEQVKTISINQV

SEQ ID NO: 14831 - protein, 15 aa, Homo Sapiens
VKTISINQVLSNKDL

SEQ ID NO: 14832 - protein, 15 aa, Homo Sapiens
NQVLSNKDLINYNKF

SEQ ID NO: 14833 - protein, 15 aa, Homo Sapiens
VLSNKDLINYNKFVQ

SEQ ID NO: 14834 - protein, 15 aa, Homo Sapiens
NKFVQSCIDWNREVL

SEQ ID NO: 14835 - protein, 15 aa, Homo Sapiens
REVLKRELGLAECDI

SEQ ID NO: 14836 - protein, 15 aa, Homo Sapiens
EVLKRELGLAECDII

SEQ ID NO: 14837 - protein, 15 aa, Homo Sapiens
LKRELGLAECDIIDI

SEQ ID NO: 14838 - protein, 15 aa, Homo Sapiens
ELGLAECDIIDIPQL

SEQ ID NO: 14839 - protein, 15 aa, Homo Sapiens
GLAECDIIDIPQLFK

SEQ ID NO: 14840 - protein, 15 aa, Homo Sapiens
LAECDIIDIPQLFKT

SEQ ID NO: 14841 - protein, 15 aa, Homo Sapiens
KTERKKATAFFPDLV

SEQ ID NO: 14842 - protein, 15 aa, Homo Sapiens
DLVNMLVLGKHLGIP

SEQ ID NO: 14843 - protein, 15 aa, Homo Sapiens
MLVLGKHLGIPKPFG

SEQ ID NO: 14844 - protein, 15 aa, Homo Sapiens
GIPKPFGPIINGCCC

SEQ ID NO: 14845 - protein, 15 aa, Homo Sapiens
KPFGPIINGCCCLEE

SEQ ID NO: 14846 - protein, 15 aa, Homo Sapiens
GPIINGCCCLEEKVR

SEQ ID NO: 14847 - protein, 15 aa, Homo Sapiens
EKVRSLLEPLGLHCT

SEQ ID NO: 14848 - protein, 15 aa, Homo Sapiens
VRSLLEPLGLHCTFI

SEQ ID NO: 14849 - protein, 15 aa, Homo Sapiens
LLEPLGLHCTFIDDF

SEQ ID NO: 14850 - protein, 15 aa, Homo Sapiens
PLGLHCTFIDDFTPY

SEQ ID NO: 14851 - protein, 15 aa, Homo Sapiens
CTFIDDFTPYHMLHG

SEQ ID NO: 14852 - protein, 15 aa, Homo Sapiens
HMLHGEVHCGTNVCR

SEQ ID NO: 14853 - protein, 15 aa, Homo Sapiens
HGEVHCGTNVCRKPF

SEQ ID NO: 14854 - protein, 15 aa, Homo Sapiens
GTNVCRKPFSFKWWN

SEQ ID NO: 14855 - protein, 15 aa, Homo Sapiens
HPTSAVCVAGVETLV

SEQ ID NO: 14856 - protein, 15 aa, Homo Sapiens
EVYGTPGVDIYISPN

SEQ ID NO: 14857 - protein, 15 aa, Homo Sapiens
GRQDRNFVDKRQWVW

SEQ ID NO: 14858 - protein, 15 aa, Homo Sapiens
SLQRIVRVSLEHPTS

SEQ ID NO: 14859 - protein, 15 aa, Homo Sapiens
SAVCVAGVETLVDIY

SEQ ID NO: 14860 - protein, 15 aa, Homo Sapiens
ERGRERADTRRWRFD

SEQ ID NO: 14861 - protein, 15 aa, Homo Sapiens
RFDATLEIIVVMNSP

SEQ ID NO: 14862 - protein, 15 aa, Homo Sapiens
QDLEDMSVMVLRTQG

SEQ ID NO: 14863 - protein, 15 aa, Homo Sapiens
MVLRTQGPAALFDDH

SEQ ID NO: 14864 - protein, 15 aa, Homo Sapiens
LVLHTSSYDAKRAQV

SEQ ID NO: 14865 - protein, 15 aa, Homo Sapiens
YDAKRAQVFHICGPE

SEQ ID NO: 14866 - protein, 15 aa, Homo Sapiens
CGPEDVCEAYRHVLG

SEQ ID NO: 14867 - protein, 15 aa, Homo Sapiens
MTPSTLPPLEVYVCR

SEQ ID NO: 14868 - protein, 15 aa, Homo Sapiens
CFVDAVAELARKAGC

SEQ ID NO: 14869 - protein, 15 aa, Homo Sapiens
KTLPVVFDSPRNGEL

SEQ ID NO: 14870 - protein, 15 aa, Homo Sapiens
PDFGYVTREPRDRSV

SEQ ID NO: 14871 - protein, 15 aa, Homo Sapiens
REPRDRSVSGLDSFG

SEQ ID NO: 14872 - protein, 15 aa, Homo Sapiens
PGSSGRRVTQVVRDF

SEQ ID NO: 14873 - protein, 15 aa, Homo Sapiens
SSGRRVTQVVRDFLH

SEQ ID NO: 14874 - protein, 15 aa, Homo Sapiens
SGRRVTQVVRDFLHA

SEQ ID NO: 14875 - protein, 15 aa, Homo Sapiens
LFVDWLAVGHVDEFL

SEQ ID NO: 14876 - protein, 15 aa, Homo Sapiens
EQVKTISINQVLSNK

SEQ ID NO: 14877 - protein, 15 aa, Homo Sapiens
RKKATAFFPDLVNML

SEQ ID NO: 14878 - protein, 15 aa, Homo Sapiens
MERGRERADTRRWRF

SEQ ID NO: 14879 - protein, 15 aa, Homo Sapiens
RRWRFDATLEIIVVM

SEQ ID NO: 14880 - protein, 15 aa, Homo Sapiens
NDLNDSHVQISYHSS

SEQ ID NO: 14881 - protein, 15 aa, Homo Sapiens
SLDCDLNCEGRQDRN

SEQ ID NO: 14882 - protein, 15 aa, Homo Sapiens
CDLNCEGRQDRNFVD

SEQ ID NO: 14883 - protein, 15 aa, Homo Sapiens
RDDPSCDVQDNCDQH

SEQ ID NO: 14884 - protein, 15 aa, Homo Sapiens
HICGPEDVCEAYRHV

SEQ ID NO: 14885 - protein, 15 aa, Homo Sapiens
VCEAYRHVLGQDKVS

SEQ ID NO: 14886 - protein, 15 aa, Homo Sapiens
HVLGQDKVSYEVPRL

SEQ ID NO: 14887 - protein, 15 aa, Homo Sapiens
GQDKVSYEVPRLHGD

SEQ ID NO: 14888 - protein, 15 aa, Homo Sapiens
EVPRLHGDEERFFVE

SEQ ID NO: 14889 - protein, 15 aa, Homo Sapiens
STLPPLEVYVCRVRN

SEQ ID NO: 14890 - protein, 15 aa, Homo Sapiens
NNTCFVDAVAELARK

SEQ ID NO: 14891 - protein, 15 aa, Homo Sapiens
ICPQAENRNDRWIQD

SEQ ID NO: 14892 - protein, 15 aa, Homo Sapiens
DEMELGYVQAPHKTL

SEQ ID NO: 14893 - protein, 15 aa, Homo Sapiens
MELGYVQAPHKTLPV

SEQ ID NO: 14894 - protein, 15 aa, Homo Sapiens
ILGPDFGYVTREPRD

SEQ ID NO: 14895 - protein, 15 aa, Homo Sapiens
DSFGNLEVSPPVVAN

SEQ ID NO: 14896 - protein, 15 aa, Homo Sapiens
VANGKEYPLGRILIG

SEQ ID NO: 14897 - protein, 15 aa, Homo Sapiens
ANGKEYPLGRILIGG

SEQ ID NO: 14898 - protein, 15 aa, Homo Sapiens
IGGNLPGSSGRRVTQ

SEQ ID NO: 14899 - protein, 15 aa, Homo Sapiens
VVRDFLHAQKVQPPV

SEQ ID NO: 14900 - protein, 15 aa, Homo Sapiens
DFLHAQKVQPPVELF

SEQ ID NO: 14901 - protein, 15 aa, Homo Sapiens
DWLAVGHVDEFLSFV

SEQ ID NO: 14902 - protein, 15 aa, Homo Sapiens
EFLSFVPAPDGKGFR

SEQ ID NO: 14903 - protein, 15 aa, Homo Sapiens
FVPAPDGKGFRMLLA

SEQ ID NO: 14904 - protein, 15 aa, Homo Sapiens
LFQGVVDDEQVKTIS

SEQ ID NO: 14905 - protein, 15 aa, Homo Sapiens
VDDEQVKTISINQVL

SEQ ID NO: 14906 - protein, 15 aa, Homo Sapiens
KTISINQVLSNKDLI

SEQ ID NO: 14907 - protein, 15 aa, Homo Sapiens
NYNKFVQSCIDWNRE

SEQ ID NO: 14908 - protein, 15 aa, Homo Sapiens
IDIPQLFKTERKKAT

SEQ ID NO: 14909 - protein, 15 aa, Homo Sapiens
DIPQLFKTERKKATA

SEQ ID NO: 14910 - protein, 15 aa, Homo Sapiens
GEVHCGTNVCRKPFS

SEQ ID NO: 14911 - protein, 15 aa, Homo Sapiens
VCVAGVETLVDIYGS

SEQ ID NO: 14912 - protein, 15 aa, Homo Sapiens
CVAGVETLVDIYGSV

SEQ ID NO: 14913 - protein, 15 aa, Homo Sapiens
GVETLVDIYGSVPEG

SEQ ID NO: 14914 - protein, 15 aa, Homo Sapiens
DIYGSVPEGTEMFEV

SEQ ID NO: 14915 - protein, 15 aa, Homo Sapiens
SVPEGTEMFEVYGTP

SEQ ID NO: 14916 - protein, 15 aa, Homo Sapiens
EMFEVYGTPGVDIYI

SEQ ID NO: 14917 - protein, 15 aa, Homo Sapiens
YISPNMERGRERADT

SEQ ID NO: 14918 - protein, 15 aa, Homo Sapiens
RERADTRRWRFDATL

SEQ ID NO: 14919 - protein, 15 aa, Homo Sapiens
DTRRWRFDATLEIIV

SEQ ID NO: 14920 - protein, 15 aa, Homo Sapiens
SPSNDLNDSHVQISY

SEQ ID NO: 14921 - protein, 15 aa, Homo Sapiens
LAYAVLYLTCVDISL

SEQ ID NO: 14922 - protein, 15 aa, Homo Sapiens
LYLTCVDISLDCDLN

SEQ ID NO: 14923 - protein, 15 aa, Homo Sapiens
LDCDLNCEGRQDRNF

SEQ ID NO: 14924 - protein, 15 aa, Homo Sapiens
DLNCEGRQDRNFVDK

SEQ ID NO: 14925 - protein, 15 aa, Homo Sapiens
NCEGRQDRNFVDKRQ

SEQ ID NO: 14926 - protein, 15 aa, Homo Sapiens
EGRQDRNFVDKRQWV

SEQ ID NO: 14927 - protein, 15 aa, Homo Sapiens
DKRQWVWGPSGYGGI

SEQ ID NO: 14928 - protein, 15 aa, Homo Sapiens
WVWGPSGYGGILLVN

SEQ ID NO: 14929 - protein, 15 aa, Homo Sapiens
VWGPSGYGGILLVNC

SEQ ID NO: 14930 - protein, 15 aa, Homo Sapiens
WGPSGYGGILLVNCD

SEQ ID NO: 14931 - protein, 15 aa, Homo Sapiens
GPSGYGGILLVNCDR

SEQ ID NO: 14932 - protein, 15 aa, Homo Sapiens
NCDRDDPSCDVQDNC

SEQ ID NO: 14933 - protein, 15 aa, Homo Sapiens
DPSCDVQDNCDQHVH

SEQ ID NO: 14934 - protein, 15 aa, Homo Sapiens
CDVQDNCDQHVHCLQ

SEQ ID NO: 14935 - protein, 15 aa, Homo Sapiens
NCDQHVHCLQDLEDM

SEQ ID NO: 14936 - protein, 15 aa, Homo Sapiens
CDQHVHCLQDLEDMS

SEQ ID NO: 14937 - protein, 15 aa, Homo Sapiens
HCLQDLEDMSVMVLR

SEQ ID NO: 14938 - protein, 15 aa, Homo Sapiens
QGPAALFDDHKLVLH

SEQ ID NO: 14939 - protein, 15 aa, Homo Sapiens
QVFHICGPEDVCEAY

SEQ ID NO: 14940 - protein, 15 aa, Homo Sapiens
GPEDVCEAYRHVLGQ

SEQ ID NO: 14941 - protein, 15 aa, Homo Sapiens
LGQDKVSYEVPRLHG

SEQ ID NO: 14942 - protein, 15 aa, Homo Sapiens
RLHGDEERFFVEGLS

SEQ ID NO: 14943 - protein, 15 aa, Homo Sapiens
LSFPDAGFTGLISFH

SEQ ID NO: 14944 - protein, 15 aa, Homo Sapiens
PDAGFTGLISFHVTL

SEQ ID NO: 14945 - protein, 15 aa, Homo Sapiens
DSNEDFSASPIFTDT

SEQ ID NO: 14946 - protein, 15 aa, Homo Sapiens
SNEDFSASPIFTDTV

SEQ ID NO: 14947 - protein, 15 aa, Homo Sapiens
FSASPIFTDTVVFRV

SEQ ID NO: 14948 - protein, 15 aa, Homo Sapiens
SASPIFTDTVVFRVA

SEQ ID NO: 14949 - protein, 15 aa, Homo Sapiens
FTDTVVFRVAPWIMT

SEQ ID NO: 14950 - protein, 15 aa, Homo Sapiens
WIMTPSTLPPLEVYV

SEQ ID NO: 14951 - protein, 15 aa, Homo Sapiens
VYVCRVRNNTCFVDA

SEQ ID NO: 14952 - protein, 15 aa, Homo Sapiens
AELARKAGCKLTICP

SEQ ID NO: 14953 - protein, 15 aa, Homo Sapiens
LARKAGCKLTICPQA

SEQ ID NO: 14954 - protein, 15 aa, Homo Sapiens
LTICPQAENRNDRWI

SEQ ID NO: 14955 - protein, 15 aa, Homo Sapiens
CPQAENRNDRWIQDE

SEQ ID NO: 14956 - protein, 15 aa, Homo Sapiens
WIQDEMELGYVQAPH

SEQ ID NO: 14957 - protein, 15 aa, Homo Sapiens
YVQAPHKTLPVVFDS

SEQ ID NO: 14958 - protein, 15 aa, Homo Sapiens
VQAPHKTLPVVFDSP

SEQ ID NO: 14959 - protein, 15 aa, Homo Sapiens
VVFDSPRNGELQDFP

SEQ ID NO: 14960 - protein, 15 aa, Homo Sapiens
RNGELQDFPYKRILG

SEQ ID NO: 14961 - protein, 15 aa, Homo Sapiens
GYVTREPRDRSVSGL

SEQ ID NO: 14962 - protein, 15 aa, Homo Sapiens
PRDRSVSGLDSFGNL

SEQ ID NO: 14963 - protein, 15 aa, Homo Sapiens
SVSGLDSFGNLEVSP

SEQ ID NO: 14964 - protein, 15 aa, Homo Sapiens
VSPPVVANGKEYPLG

SEQ ID NO: 14965 - protein, 15 aa, Homo Sapiens
LHAQKVQPPVELFVD

SEQ ID NO: 14966 - protein, 15 aa, Homo Sapiens
HAQKVQPPVELFVDW

SEQ ID NO: 14967 - protein, 15 aa, Homo Sapiens
KVQPPVELFVDWLAV

SEQ ID NO: 14968 - protein, 15 aa, Homo Sapiens
LAVGHVDEFLSFVPA

SEQ ID NO: 14969 - protein, 15 aa, Homo Sapiens
VPAPDGKGFRMLLAS

SEQ ID NO: 14970 - protein, 15 aa, Homo Sapiens
MLLASPGACFKLFQE

SEQ ID NO: 14971 - protein, 15 aa, Homo Sapiens
LLASPGACFKLFQEK

SEQ ID NO: 14972 - protein, 15 aa, Homo Sapiens
QEKQKCGHGRALLFQ

SEQ ID NO: 14973 - protein, 15 aa, Homo Sapiens
KQKCGHGRALLFQGV

SEQ ID NO: 14974 - protein, 15 aa, Homo Sapiens
HGRALLFQGVVDDEQ

SEQ ID NO: 14975 - protein, 15 aa, Homo Sapiens
FVQSCIDWNREVLKR

SEQ ID NO: 14976 - protein, 15 aa, Homo Sapiens
SCIDWNREVLKRELG

SEQ ID NO: 14977 - protein, 15 aa, Homo Sapiens
RELGLAECDIIDIPQ

SEQ ID NO: 14978 - protein, 15 aa, Homo Sapiens
AECDIIDIPQLFKTE

SEQ ID NO: 14979 - protein, 15 aa, Homo Sapiens
KKATAFFPDLVNMLV

SEQ ID NO: 14980 - protein, 15 aa, Homo Sapiens
KATAFFPDLVNMLVL

SEQ ID NO: 14981 - protein, 15 aa, Homo Sapiens
LGIPKPFGPIINGCC

SEQ ID NO: 14982 - protein, 15 aa, Homo Sapiens
IPKPFGPIINGCCCL

SEQ ID NO: 14983 - protein, 15 aa, Homo Sapiens
IINGCCCLEEKVRSL

SEQ ID NO: 14984 - protein, 15 aa, Homo Sapiens
GCCCLEEKVRSLLEP

SEQ ID NO: 14985 - protein, 15 aa, Homo Sapiens
KVRSLLEPLGLHCTF

SEQ ID NO: 14986 - protein, 15 aa, Homo Sapiens
LHCTFIDDFTPYHML

SEQ ID NO: 14987 - protein, 15 aa, Homo Sapiens
MLHGEVHCGTNVCRK

SEQ ID NO: 14988 - protein, 15 aa, Homo Sapiens
LHGEVHCGTNVCRKP

SEQ ID NO: 14989 - protein, 15 aa, Homo Sapiens
TNVCRKPFSFKWWNM

SEQ ID NO: 14990 - protein, 15 aa, Homo Sapiens
VAPWIMTPSTLAPLE

SEQ ID NO: 14991 - protein, 15 aa, Homo Sapiens
APLEVYVCRVRNNTC

SEQ ID NO: 14992 - protein, 15 aa, Homo Sapiens
PSTLAPLEVYVCRVR

SEQ ID NO: 14993 - protein, 15 aa, Homo Sapiens
VFRVAPWIMTPSTLA

SEQ ID NO: 14994 - protein, 15 aa, Homo Sapiens
APWIMTPSTLAPLEV

SEQ ID NO: 14995 - protein, 15 aa, Homo Sapiens
LAPLEVYVCRVRNNT

SEQ ID NO: 14996 - protein, 15 aa, Homo Sapiens
PWIMTPSTLAPLEVY

SEQ ID NO: 14997 - protein, 15 aa, Homo Sapiens
TLAPLEVYVCRVRNN

SEQ ID NO: 14998 - protein, 15 aa, Homo Sapiens
FRVAPWIMTPSTLAP

SEQ ID NO: 14999 - protein, 15 aa, Homo Sapiens
RVAPWIMTPSTLAPL

SEQ ID NO: 15000 - protein, 15 aa, Homo Sapiens
IMTPSTLAPLEVYVC

SEQ ID NO: 15001 - protein, 15 aa, Homo Sapiens
MTPSTLAPLEVYVCR

SEQ ID NO: 15002 - protein, 15 aa, Homo Sapiens
STLAPLEVYVCRVRN

SEQ ID NO: 15003 - protein, 15 aa, Homo Sapiens
WIMTPSTLAPLEVYV

SEQ ID NO: 15004 - protein, 15 aa, Homo Sapiens
FLSFVPVPDGKGFRM

SEQ ID NO: 15005 - protein, 15 aa, Homo Sapiens
DEFLSFVPVPDGKGF

SEQ ID NO: 15006 - protein, 15 aa, Homo Sapiens
VGHVDEFLSFVPVPD

SEQ ID NO: 15007 - protein, 15 aa, Homo Sapiens
VDEFLSFVPVPDGKG

SEQ ID NO: 15008 - protein, 15 aa, Homo Sapiens
PVPDGKGFRMLLASP

SEQ ID NO: 15009 - protein, 15 aa, Homo Sapiens
HVDEFLSFVPVPDGK

SEQ ID NO: 15010 - protein, 15 aa, Homo Sapiens
SFVPVPDGKGFRMLL

SEQ ID NO: 15011 - protein, 15 aa, Homo Sapiens
FVPVPDGKGFRMLLA

SEQ ID NO: 15012 - protein, 15 aa, Homo Sapiens
LSFVPVPDGKGFRML

SEQ ID NO: 15013 - protein, 15 aa, Homo Sapiens
VPDGKGFRMLLASPG

SEQ ID NO: 15014 - protein, 15 aa, Homo Sapiens
GHVDEFLSFVPVPDG

SEQ ID NO: 15015 - protein, 15 aa, Homo Sapiens
EFLSFVPVPDGKGFR

SEQ ID NO: 15016 - protein, 15 aa, Homo Sapiens
LAVGHVDEFLSFVPV

SEQ ID NO: 15017 - protein, 15 aa, Homo Sapiens
VPVPDGKGFRMLLAS

The invention claimed is:

1. An isolated or recombinant protein comprising SEQ ID NO:5 or SEQ ID NO:7.

2. The protein of claim 1 which is SEQ ID NO: 5.

3. The protein of claim 1 which is SEQ ID NO: 7.

4. A composition comprising the protein of claim 1 and a pharmaceutically acceptable carrier.

5. A composition comprising the protein of claim 2 and a pharmaceutically acceptable carrier.

6. A composition comprising the protein of claim 3 and a pharmaceutically acceptable carrier.

7. A method of generating a mammalian immune response directed to a protein of claim 1 comprising:
exposing cells of the mammal's immune system to said protein
whereby an immune response is generated to said protein.

8. A method of generating a mammalian immune response directed to a protein of claim 2 comprising:
exposing cells of the mammal's immune system to said protein
whereby an immune response is generated to said protein.

9. A method of generating a mammalian immune response directed to a protein of claim 3 comprising:
exposing cells of the mammal's immune system to said protein
whereby an immune response is generated to said protein.

10. A method of detecting the presence of cancer in a sample comprising
comparing the level of the protein of claim 1 or a polynucleotide expressing the protein in a test sample with the level of the protein or a polynucleotide expressing the protein in a normal sample,
wherein the presence of an elevated amount of the protein or polynucleotide in the test sample in relation to the normal sample is indicative of the presence of a cancer.

11. A method of detecting the presence of cancer in a sample comprising
comparing the level of the protein of claim 2 or a polynucleotide expressing the protein in a test sample with the level of the protein or a polynucleotide expressing the protein in a normal sample,
wherein the presence of an elevated amount of the protein or polynucleotide in the test sample in relation to the normal sample is indicative of the presence of a cancer.

12. A method of detecting the presence of cancer in a sample comprising
comparing the level of the protein of claim 2 or a polynucleotide expressing the protein in a test sample with the level of the protein or a polynucleotide expressing the protein in a normal sample,
wherein the presence of an elevated amount of the protein or polynucleotide in the test sample in relation to the normal sample is indicative of the presence of a cancer.

13. The method of claim 10,
wherein the cancer is bladder, kidney, or lung cancer.

14. The method of claim 11,
wherein the cancer is bladder, kidney, or lung cancer.

15. The method of claim 12,
wherein the cancer is bladder, kidney, or lung cancer.

* * * * *

UNITED STATES PATENT AND TRADEMARK OFFICE
CERTIFICATE OF CORRECTION

PATENT NO.         : 7,135,549 B1                                               Page 1 of 1
APPLICATION NO.  : 10/120901
DATED              : November 14, 2006
INVENTOR(S)      : Challita-Eid et al.

It is certified that error appears in the above-identified patent and that said Letters Patent is hereby corrected as shown below:

On the cover page, item

[*] Notice:    Subject to any disclaimer, the term of this patent is extended or adjusted under 35 USC 154(b) by 186 days Delete the phrase "by 186 days" and insert -- by 334 days --

Signed and Sealed this

Twenty-eighth Day of April, 2009

JOHN DOLL
*Acting Director of the United States Patent and Trademark Office*

UNITED STATES PATENT AND TRADEMARK OFFICE
CERTIFICATE OF CORRECTION

PATENT NO.        : 7,135,549 B1                                                            Page 1 of 1
APPLICATION NO.   : 10/120901
DATED             : November 14, 2006
INVENTOR(S)       : Challita-Eid et al.

It is certified that error appears in the above-identified patent and that said Letters Patent is hereby corrected as shown below:

On the cover page, item [*] Notice:      Subject to any disclaimer, the term of this patent is extended or adjusted under 35 USC 154(b) by 334 days Delete the phrase "by 334 days" and insert -- by 306 days --

Signed and Sealed this

Sixteenth Day of June, 2009

JOHN DOLL
*Acting Director of the United States Patent and Trademark Office*